United States Patent 10,233,495 (METHODS AND COMPOSITIONS FOR SCREENING AND TREATING DEVELOPMENTAL DISORDERS) - sequence listing, part 138

SEQ ID NO: 680 - DNA, 1261616 bp, Homo sapiens
agaaagacatgctaattaacagaattattaaacccattgtgatacaccattcactcaccatgtgactgcttacaaagagggaaaaaatatggagccctctgttccaagggaacactcctttccccctcccgacacttcctagagatcttagacccacatgactgtgagaaagaagagtgatgtgagagtgaactttggcaaggctgaagtgccctggttttgtctggagcgagaataaaagtgagaggaaggaggcgtccagttggctgagaatactgttggctaagattctttagcagggtgggcttttcggatgcttttctcctctgatctatttaggtttatccttactcttttccatttatctgggaagtgacttgggtttaagagaaccaggagtatcttagcagagtcaaaagggccacggtgaaccccaaatgtcaggaaacaaggaactgactagattactcaaggcttcactcttgaggagggagagaaaagagctcctgcatttccttctatttattgattacagccacaaatggaaaaggaagcaggctttctgccctgaaataatgatgatacatcgggctgcagagctcctatacctataactctcaaaagcaaatggaaaggagactagcgtgtggctagtaccattattctcacatcttcctgcagtgttatgagagcacagagtaggatgcagggtgaggatagacagcagtagagctttcttgagctgcttattcctctccaaattctctctgaaagtggatgaagaactgctgccatgtctggtgtgggttcaatttgtgctctcattgcttctacttctctgtttctccagatcctaccatcacgttcttccttctgtggcttagccatttttctctccacgcttaggaaccatacatactatcattcttctacctctgaagcattatcccatccttctgacaaacatgagtagatgttttcccctcacagtcttgccaaaaagcacttataaagtattgcaccgtagttttcatatttcaaaaacacttcaacaggcaaaatgcgatatacacaaccccaaaatgctgtgctatgatgaatttagttctgtattggtaatactataaattgcttttgaatgaaagatacaatgtctatatattatttaatttgatacttgcagtaactagctatttaagcaagataggtatcagtcctctttagcgaagttcagtggaaccaatggaacaaacgtgtgggagtggaactggaactcggatgtctgattttgtcttaagttattttaatgacaagtcatttagccaccgataaaaagttacttattcagaaaattcaatcttctggacaagttttatttttacatgacataacctaaaatgttatatatgttaaattctgccgttttagatttcaggaaaacaaatgcagagtggtagaggctggtggtgagaatgagctgagaagggtggtaataaactgaggtttctacaacgagtttgcattaaaaaaaacttgttgggggttctggaacccaatcaattctcagatgtttccatagtctatttttatatagcataatacatttttattatgatcaggcaataaagcaagactgttcaccagtcttgctttagccatttaccatttcctatactctatgtatgtcctttgtctgcttttacactaccataaagcctgcttcaactttcccctcaatacactgagatttatttcttcactcaccattctggaaaattccttgttcagccttctaatcactagacacctgcaacctttccttcactggatttctgcctcgaacagtcactcttctccactaagatctacatgtcaccgctaaaatcccctttcttgcttgtcactttgaccatgatgtcacttacttcctgaaaatttcccctggctccctactgctttgcaggccaagtaactgtcacatttcgtttccactttcagctggagtcagccttcattattcccctctccgtccctgtatccttagagaccctctcctttgactcaacagctcactgctcttgtcttctcaaagctcctgtcttttcacacacagttcctgctgtcttttcttcttaaaacaaccagccattcgacagtctccaattctctgagaagacattcccctaaactcaccatcttcaatacttgtgtcatatctttgtgccaaattctaattcacttaagattttaactggcttactaacaaaatatactaacttaaaatgaaggttttatttattaccttaaatgaaacaccagtgtcaacggcaaacaatgaaaagtaagagcaaacgttactatgatgaaagcaacttgaagtcattgcattttaggtagatatttgtgcctgccccagactctgggcttgaaccctgctctgtcttataaaatagggagattagaaaagttaaattgttattaatgttctattaacacctacttgagactttcaactttttatagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaaagattatttccagcttgtgcactgttaaaagtcattaggaaagaggtagaatttggaaagcaaagaagagattgcattgcaaagaagacattcaattgcaatgattatttctctgaagcaaaataagtgttcaagcccaatttaatgagcaattaatttttagcaatattttccacatgttcataatctagtaccatttgaaaaaactttctgatgtgaaaaaaatgtgatttaaatacctgtctcaagttctgaaaggcttcctcacatattataaaacaggagccctccctaatttgagtcaggttagagaaagccaaacataggtggaatatggatacctttactacaactacatttggggagtcaacctaatgcttgcttaatcgcttcacagaaagattgaggaaggcagtgatatccagtatcatcatagggctctttggtgccaataatctattgaggtgcttttcgattgtgagacgaccaagaaattagctgatcccagcagaaaaacagagctccttccttacttttcagctgcgttaatttcttctctacgtttcagagtactgctaattccatccactgatcccttctagggcctggttttcagtcctaggcactcaggtaaggctattctctagacacaatatgcatgtgaaacaaaaaaagagaaaagtaataatgacttcaaatattaggatctgactatgaaatatcagatcttttaactcttgtattcatgtaaccttcctacatttttcaagtgaaaatatttcctacattttttaagagacatcagtgttacgtgctacgttatcaatattattttcttattggccatggaaatgcttaaataattgacttgacttgttaaatctattttatacattgcattttaattacatttataattttaagaaacttcactttttagaaagatatagacatgaatacccttggtattaattagtagtagatgtccttacttctgatagcccttacataatgtatccctctctatgagtgctgtagatttttcacttatatctacaaatacagaagatataacttattaaaagttcaataggaataagtcctcatgttatgagagagtataaagcaatagttagagtgatgtgaaatattataactctgtcttctggaattattccttgaaaagattaattatgtatgcctaatgagataacagtgacaaggtataatttagagattataaagctgagaattgaaatgcctagcatgtgcacgtgcacacacacacacacacacacacacacgtaactgctcttttgcaaatcttcatcacatcaattgtgttgaatccattctcttaggctatacattctcatgctagcaaaatgaaaacttgaaagtaatatgttgaagagatactatgttgaagagattcccatgttgattgcagcattatttacaatagccaagatatagaatcaacctaagtgtccatcaacagatgaataaagaaaatgtggtgtatatatacacaattgaatagtactcagccataataagaatgaaatcctgtcattgtggtaacatggatgaatctagaggacaatatgctaagtgaaataagcaaggcacagaaagactaatatcccacgttctcactcatttgtggagtctgaaaaagctgatgtcacaaaagtacagagttattagtgactccggaatgtatcaaggaggggaggataggaagagattggtcaatgacataaaattacaattagacaggagaaataagttctggtgttctatagcatagttgggtgactatagtaaacagtattatagtttgtatttccaaataactagaagagaggatcctgagttctcaccacaaagaaataatgtttcaggagacggatatgcgaaagccaatgtacacatgtatccaatcattatgatgtactccatagatgtgtgtacttattgtgtatcaattaaaaacacaattcaaaaattgtcatgggtttgctctttttttttgcattacaaagtgacatctatttcttgactacatgctaggtgattaattataaaatggctctgtgcattgaagcatctctttcaagagctttacaacctgacttttgggaaagatacattgtatcttttgaatgattcaatagtgaaatttatttctgagtttaccattttgtgatttctgaattttttcactttcagcatttccactagtgttttatttactggttccacaaatcagtcagtttcatcaaatttgccaactgcaagcctaaaccattggaaattggcataatgaatgttctgagtgagaatatatatgttattaggaatattttaaatataagaaaatgtgatacaaacctggctgccaaaatatggcaaaaatgtaaacaaaaattgatgtgtaaaaaataccactgtatttaaaagggataaaactaatcagatagtattttaaagctgatgtcttgatggcacaattttaaattgaagtgctatgggggatattgtcttactggtatttgcagtttgggctcaaaaaaccagaaactatatctttaagggtgtttaacagaataattctaaatattatagttttctctttcctttttgttgtcctgtgattttaactttgacattcttatgtgacaattgaaaaagtctcttcacttttgtgtattctttctaatgtgatcaggagaattaaaatgaacattttctttcataaagctgagagttaattctgaaacgttgtaccagaatacttttatgaatgaaagactagcctttgaaccctaggagagtcaactctacaccaaccctgtctattaaaaaaagtctgtgcttacagatgtcttgtgtgagatgtggctttaccaaaagtatctgaacttcaaatttctcctatcactgccaactacccatgggtattggcaatatatttggtagacttatttcttctgtaggcatatgatgccatggccaaagtgaactctacatttttaagagaggctgctaaatatggccaatcacaacagaaaactagcatttctccaatttggcagtggtttctggatggcacacccagacttacttccttaagcaatgctgatatatggaaatgccatgatagaggctcagaagctaacactgaattcagcagtgcagaaaaactccaaatcatgtggttcttctttgtcaatattttcactaaggcagcataagatattaaatcacctggaattagttatgtgccatttcagcaaccttttgtgctcagtctgctacaagctgcttgtgctgattagcagtttaaaagtctgcaggggaaggaaattttcagtagcttgattttcccccaccctttggtcctgtgtgcattggggaagaaattaccttctgtgcaattcctgaataatttggtttgattattaatagattcatgctgaaaaaagaacaataacagaaaaaaaattacccatggggttgcagctgtgctcccagatacaaaacagggaaagaaaacaggtctctccaagcaaagggtatatgtgtatacgtgtgtgtgcatgtgtagctctgattctaagaagccattggttcatttattcatgcatcaaatatttattgagctgcgaacaaatcccaggcactgtgaggaagacagatttcctgccctcccagagttgccattactaagaatgttagccaataaataaatctttacgggaaagaaacaaaggactgtgatagaaaaaaatgggaggagaaacttactttagaaaggattatctgagaaggtgcctttcacgctgagccagaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgagcttagggcagatcacataaggccttgtaggtcatggacaacaatatggatttaagtgcagtataggaacttcaaaggaattccaacagttaagctagttgatgtaatttgtgtctatatgtatatatatttatatatacaaacaaaacaaaccttggctgttgcatgcagagtagattgcaatggagaggaggaccagttggtattccgcaagggagataagaacagcttaggcttgaatgaggatgtgataaaggggattttatgagcaaggctgttttattattttatttattgtacttctattaagatgatatgggtgctttgggggctgttgtaaattataacccacagcccctgcacaggaaacctccacaggaaacaatcaaagaataagtggttgtgagatgacaaggtttacgatacgtgttttcaggcttcttaatagcagagtgattgggtgatttccaaaagacctcagggctgggatgggtgaaattttgtgagcttctggattggatgagggtgtgctcttgcagaaagaattcctgaatactttctgcactgacagaacctgcttattaattcttacagcagttatgttttagaagatgaaagaccctttccattcaattattgatcataagcatgatgtgtgttgattaaaatggcatgataatggtatcaaatggagtttggatatctttttccttaatatacttttgtgtatcatatttaagtttcctcaagtcagtagagaagatgttacccacatcctcttttccaaagaaggaatcatttgatcattgaaaggtttactgaatagaaaataaattatgttgactttagcacaaattcctgccctaagttttagcccatatattgatgatgtcaagtgctgctaaatgtgttcttcttctataaaaattaaagtttaagctttggatgctaactttcaaatctatgtgaaatgatatgatttattgtgatataaagaatgacataaagaacaaaataatacttttttaaatttatgaggaaaaagacaacagaaaggaaaaatgggcaaagaaagagaacacgtttcatgcaaatcaaaaccacaatgagataccatttcgcaccggtcagaatggttataattgaaaagtcaaaaagtaggccgggcgcactggctcacacctgtaatcccagcactttgggaggccaagacgggcggatcacgaggtcaggagatcgagaccgtcctggctaacacggtgaaaccccgtcagtaaataaaaaatacaaaaaaattagctgggcatggtggcgggcacctgtagtcccagctactccagaggctgaggcaggagaatggcatgaacccgggaggtggagcttgcagtgagccgagatcatgccactgcactccagcctgggcgacagagtgagactctgtcaaaaaaaaaaaggtcaaaaaataaaagatgcaggtgaggttgtgtggagaaaaaggaagagaaagtacactgttagcgggggtgtaaattaggtcaaccgttgtagaagacagtgtggtgactcctcaaagacctgaagacagaaataccattcaatcctgcaatcccattactatatatattcccaaaggaatataaatttttacattatgttaaaaagacacattcatatgtatgttcattgcagcactattcacaatagcaaagacataaaatcaacctaaatgcccatcaatgacatcaataacagactggataaaggaaatgtagtacatatgcaccatggactattatgcagccattaaaaaagaatgagatcatgtcctttgcatggacatggatggagctggaggctattatccttagcaaactaatgcaggacctaatgcaggaaaaccaaatactgcatgttctcacttataagtggaagctaagtgatgagaaaacatgaacacttagaggagaacaacacacactggggcctacttgaaggtggagggtgggaggagggagaggatcagaaaaattaactaatgggaactaggcttaatgaaatagtctgtacaacaaacccacatgacacaggtttacctgtgtaacaaactggcacatgtacccctgaacttaaaatgaaagttttttaaaaaagagaacacatttcagaaaaaaactcaaatggccaaaatacatactaagatagacaacctcatgaatagtcaggggaatgcacattgaaatcacagtgaaacaattgttcatctacatcattgaataatacttagtatctaaaagggatggactactgatatatgcaacaaaataaatgactcttaaaagcattatgctaggtgaaagaaagttacatactgtgggatttcatttatacgatattttggaaaaggtgaaattgaagggatagcaatagaatcattgtttttaaagactggggagggtggttgacgactgacatgatgggaatactgtgtgctgattgtggtggtattaataccccatctacctttgtcaatattcattgaattgtacctttacaaatttggttattgtgatgtatgtaaattaaaccttcaatgatctgattttaaacattacagtgaagtcaggagtggtggtatgcacctgtagttccagctactcaggaggctgaggtggaaggatctcttgagcctggaaattcgaggctgtagcatgggtgtccaaccttttgactaccctgggccacattggaagaagaagaattgtcttgagccacacataaaatacactaacactaacgatagctgatgagttgttttttttttaaaaaaaggtccatgcataatttttgtgatatctgtcatgccaccacagatatcaaagaagtcctcacattcaaaggattttacacctatgcatgtagaatgctataattgcacctgtgagtagccactgcactccagcttgggcaacatagtgagatcccatcacaaaaaagactcacaatgagaaaatgttatcatttattagactacaacaatgaaaatatgtagtacagaatcttgtgaaggtgttaggaaatgagaacgctcatgctctgttggtgtgagtggacagtggcataacctccttttagaggaggaatttcacatcagctagtaaagttgaacatgttttaacccacaccttcgaaagtctgataaacatttacaatcaattgtctctgaagcctactacctggaggcctcatctggatagaaccttggtctccacaaccatccttatcttaaccaagacactcccttctatcgattccaggtctttagataaactccttggactagttgccaattagaaaatctttgaatccacctatgacctgaaatcccacactcacccactttgagttgtctcacctttccagaatgaaccaatgtacatgtttcatgcatttattgatgtcttatttctccttaaaatggataaaaccaagctgtagcccgaccaccttgggcacgtgttctcaggatctcctgaagctgtgtcatgggccatggtcactcgtgtggctcggaataaatctcatcaaatattttacagaatttgactcttttcattgacactaatcatcattgtaaaattaagactatagtaatcagtgcattttgagccctcagttgttcaagtactatcacagaagatcgatatcaacttttgtttcagctccagattaaaaggtgagcctattagagtgtttatgtgtagcagaccctacacttattcaaagaatcatttgcttagatctaagagaaatctcatcccttttacttttaatatcatggtccttgtgaaagaccagacaaaaagtcaacccagttagttccttaaaagaggaaaagtagagggaattcgcatgagcaacacctcagtacttaacagtcattcaaggacttatgcatcaacagtacttggcatttcatgtaatccttccaatgttcttatcagttctgtgtgttcttaccattgaaatatagatgtgcacaccattgaaaagtttaaatcattaatttagtattaagttaacaagaacatagatgctacacctaaacttatccaagatattaatccattgtgccttagtactttattgactcaatttataaaaatattgtatgtgttcagtaaaaatataactacatttaagacataagtttgattttatgacttaggtttctgtaagaagcagcatacttttaactcaggcttatgaatataatatcacttcatctccttacaaagtaattagaataaaggcagcatatattttgtatgaactaaaaagaagtacaaaatattggtccccaaaattaaaatgtaagttcttaactacacatttctatgctatattacttgtattagtttcccattatggtaataaccaagttcctcaaatttagtggcttaaaccaacatacctttttctgttagagatctgaagtttagaagtcctaaaatcaaggtggcagcagggctgtacctttctagaagctctaggggagaatctgtttacttgccttttttttagcttctagaggccacttgcactctagctcacggtcctgttggagctcaggggaagctgccctcttgcccttggatggtttgctgaaaaatgaagccacaataaggcatgttaataagaagaaagcataaaatttatttacccatatgcatgtggagaatcacagagtgattacctaattacccaatcaaacccaaacacttatataacctcctttcagaagagcgggggtagatgggaaatataggtaattcctttgacggacattacatgattactagggaaaagtaaatggatccttgggaaaacgaatagatggacttgtaaatgatttggaagttgaatgaacttcagagacaggcactattttgtagaaaggctgtgccagttctgaatacattctttcactcctgtcttgaaatagataatgagataacagggaagggaaggaaaaacaattttttttttggtggatccatcctatttttatgaagatggggaaaagtctcttctaacgcatattgatttctaagggattttaattcaaagtattcattacttccagggaatcatattttggggtgaaattctctgtgtttttttagtgccatccttcatttttatagccagcagtatagcatcttccaattttcctttctttctgggctctgtcctcaaaacatcttttcagattctgaccctccagcttctcttgtgtaaagacacttgttatacattggcccacccacataatccaggacaatatctccctctcaaaatcctgaatcaccttacatttgcaaagtcctatttccaatgtaaggtaatattctcaggtcctagcaactaggacacgaacatctttggggttattattttaatcagttgctccaccctttaaactcttttctggttgatatatccataaaattaagtgacattcgggtgaagtgtcatcacccatcactatccctatctgatataaaacaatgatacttaagtgaagtgttataggaatacaaatttgcactatgaagttaatattagaagataaacatcctctaaatattatcttatggaggtaagatgacttttgtgtgaggactataccatcttttattcttggagtaatttactattcagaatgtggtcagttttggcacgttgtcagaactgcaactgtgtaaggaataaagaataagacctatctcagaaggttgttgcaattattaaataaattattattttggcatatagacttgctatgtatttactgcagttgttaatattagatccatgtgaactatcaaaaattgtattataattgtccaacaggttcttcttgcccactgcatggatagggcaaattcactgagacagcggtattacagtagagaaagagtttaataattgcaggcccagtgaagcagaaggactggatttattattactcagatcagcatctctgaaagctcagaggctaaggtttttccaggatagtttggtaggcagggggctagggaatgggaaatgctgataggttggggcagggatgaaatcataggggtcaaagctgtcttcttacatgaagtcacttcttgggtgggagctccaggactggttgaattagttccttggtatgagtcacagatcctggtggagtcagctggcctgcccaaatgcaagagtctgaaaaatacctcaaagactaatcttaggttttcacaataatgatgttacctataggagcaattgggaaggttacaaatcttgtaacctctggcacaatggctggttattgtttaactgtacctacatcctaatagagttcaggcccctcccataatcctagtcttgtggccttttattacttttacaaaggtggttttggtccctgaacaaggagggagtagtttggggaagggctatttttatccttgttttaaagttaaactataaactaaatttctcccaaagatagcttggcctatgtcgaggaatgaccaaggacagcttggagttgagaagcaagatggagtcagctatgtcagatttctctttgatatagtttgaatatatatctccgccaaatctaatgttgaaatgtaatccccagtgttcgagattaggcctggtaggagaggtgtttgggtcatgggaacagatcccgtatggcctggtgctgtcctcgtgatatagagtgagtactcatgagatctggttgtttaaaagtaggtggctcctccccaactaagtctctctctagcttctccttccaccatatggtgtgcctgctccaactttgccttctaccacgagtaaaaactccctaatgctcacccagaagccaagcagatgccagtgccatgcttgtacagcttgaagaagcatgagccagtgaaaactcttttctttacaaattacccggtctcaggtatttctttatagcaatgcaagaatggcctaatacatttattgtcataattttgcaaacgtagcttccctgttggctacatcaaattgagggtttgctaggatagaaaagtggaaaatatcaattaaacaactcagagccgggtgcagtggctcacgcctgtaatcccagctactcaggaggctgaggcgtgcagatcacctaaggtcgagagttcaagaccagcctggccaacatggtgacaccccatctctactaaaaacagaaaaattagccaggtgtggtggctcacgcctgtaatcccagctactcaggaggccgggcgggagaacacttgaactcaggaggcagaggctgcagtaagccaagatctcgccactgcactccagcctgagtgacagagtgagactctatctcaaaaagaactcaaaaagattgtgttaggtacttacagactagaagattatgttaatgaatcttttattcattcaacatataattattgcccactgagtatgtaacacgttttctgttatgtttagaaataattatgagcaactcagaatgatctccaccctcagagagtgtacagtctacctcagtatgtagatgattaatagacaaacaataagtgttgaatgttgcacaaactgtcctttatttgatccttagagttatatagcatatttaaacattttgaagtttgaaaatgcatacaaattagagagacatccaataaggtaggacttgggttaatgtttactttcctcaagcacgagaatagtatgtgagaattaagaattaattgttaaaacacatctttatatttctttatgagacaactcttgaagcaaaagtgaaagctggctcaaacacagttcaattacacagacgtatacacacacttatagtcacacacacacacaaaaccaccactgtccaggaactaaacaataattgtactcttctagatatgtaaaatcaagcgaggaacagttaagaataggttatggccaagcgtggtggctcacgcctgtaatcccagcactttgggaggctgaggtgggcagatcacgaggtcaggagattgaggccatcctggctaactctgtgaaaacccgtctctactaaaaattcaaaaaattagccaggtgtggtggcaggcacctgtagtcccagctactcggggggctgaggcaggagaatcacttgaacctgggaggcggagcttgcagtgagccgagatagcaccagtgcacttcagcccgggagacagaatgagactctgtctaaaaaaaagagacacgttaatcttaactttttttgagagagtctcgttccgtcgcccaggagagagtgcggaggcacgatctcagctcactgcaacctccaccgtcaggttcaagtgattctcgtgcctcagcctcctgagtagctgggactacaggcatgcaccactatgcccagctaattttttatatttttagtagagacggggttttaccatgttggccacgctaatgttgagctcctggtgtcatgtgatccgcctgcttcggcctcccaaagtgcggatcccaaagtaggattacaggcatgagccaccatgccaggctgaaaattctgtattctattatatattatataatagaatattttatatatatatacttatatattatataatatataattatacacacatatatattttttaattttattattattattattttttctgagacggagttttgctctgtcgcccaggctggggtgcaatggcgtgatctggggtcactgcatcaccgcaacctccaactcccggattcaatcgattctcctgcttcagcctcccgagtggctgggattacaagcgcacaccacgcccagctaattcttgtatttttagtagagacagggtttcaccatgttggccagactgttcttgaactcctgacctcagcagatccacctgccttgacctcccaaagtgctgagattacaggcgtaagccaccgcgcccgacctgtagtacctatattttttatttttctccaatcttttaatcttttaatcattctccaaaatgttgcctttcttctcaatgcttagcagacaatttgataaacaaggatccttttctaagtagacttcatataggagagttttcaaaacagaataagaagggcatattattccttgtcaaaatattttcttgttgaaaatggaaagtttttgctaaaagctgaaatgcatggcagattaatttatgcctattacttcaggtaaataatttcaccaggagtcttcataggtaaaatgaatgtttatgcttgataaaaaagtagcagttgttgatttcaacaggtttaagaagcgtaaatgttgtccacctcttctttccatcccatgcacatcttacttttactctagtaactaccacccatgaatgtccatctattaaacccaagcagagagtagtttttaaaatattcctttcctgttttctgttgaactattttatagacaagctatataaaaaagaaacacaaggaacaaaaaatgatatcttattctagtgaaggaaatccaaagttggggtctagaatacaaatacacctgtgtgcaagctccagtgatgccagttcctagtactggagagcattgtgactctgagcaaaagagggaagacaaacatatgaacagaaaacctcgtcttttctcaaacatcctcaatgactgttacatgaaaatgaggactatcaggctcatatcattttcaaagacaataggtgatatgcatgtggagaacaaatacaaaaggcatgcatagaaatcaaaagtgattaaaaatagtctgaattctggagacaatagcatgtgtggacggacagatgctacagatttaatgctgacatatcagagatgaaatgtcagctttctttattaccagtagctctcagcttttcaggcaaatcgttctttgtactctacgttctttctccttatggagttccttcttgatgcctcttcctacttcttcacatctttctactccttgagatacctgcactcattgcttgcacttctgttagtgattttgttacagtattgtgctgtgtgtttccaggagtggagccaaagtgaaggaagcccagaaatgcctgtcaagggagactatgagatgataacagcactcgtctttttccttgtgcttcttgcagttaacacccacatctatctatccatctatttgtgtatctctgtgtctgtctgtctgactatcgatctatccatcacccattcatctactcatttattttggcatacagcttttcgatagaggcaaacactgcctaatggaattgatctacaacaagaccatagctggagtgaaagaaccaggactcagaagttaaaaccaaagttaatgttattggaatgtatagtcttaaaaacaatatgttttttaaggacaattttaattcaattaagtgtgcaatgaaaacacaggggaatgtttgaagaatcttttatcttttacccaggtgatgtgcttttcgacaggattacatttagtctaagaggtagaaaaacgtcaccaacgacaccttaaaggcttaccccaaccaccagaaaaatatttgtactatttccttcttaaactttgcacaactttttatgtagatattaagtgttcaaggggatccctgcacatggatgaagtcatgtttgcatacactcagtgtaaatatgtgtacacacacacacacacacacacacagcaggggaaatatttctcaaatgactacacttaggttactttccatctctatttattttcttctgtggaataatgcagactagaactaacataaattgaatgctcatgagaccacacatcttcacatggtatagagtgtgttatcgcagcaattttataatggctcattaacccctgtgagaggccagtaatatgggatagcaacggatttctatcaactccatgagggagataagtaaggtggcatcttatgtagatttctaaatcctctactttgaaatcagctcaatggcatattttaaactcaaaatagaatgtcttctggttcctaatggttgatttaatggtggatttgaccatatgtgtatcagatgtaaaaagtattgtccactaagtggagtaaaaaatgatcttttacagaaggaaaaaaaaactgatttaaatctttagattctcatgggatctcattaaggttctctttctttaatacattgtgcagcctaatagttatcagcagccctgcggtgtgcattgctgataggttagtttacacaggattaattgtgtaattttgcaagcaaccagcacagtgaacactgatttttgcattagccccatgtgttgtttccaaggggactctgctttctattttaaggtggtgttacatttcacttcttattaattataatttctgctagcatgttttatgcccaatatgatttattaaaaatccttcataatgtttttttcctaattgttatgtccttcggtaacttcattaattttgagcactgatgtgtaaaaaatggcaggagaaaatggcattcacagaaggttctctgaccagccagtttccccatgcccccgttgataagttgccacaaatcttttgctaaaatacagacacaaattcagttgcagccactccaggtatgcgaagtgaataatcagtgcaggcaacaacctgacaatactacattcctcaaaccaaaagaatgcgaatgttcaaagaagtgttggctaagcagaactcagtccattttccacaatacgtagcttagtattttccagaaatacttgtgtattcggaagaattagaggaaggaaacttttgtttgaattttccacataatagcttagttcaatactcagctactacattttatcgactcttggtgggattatgaaatgcctattgaggtttcagtggaatctttatagctggacttgatattcttttacatggttttgaaaaaacaaaacaaaacaaaatgttgactgtgcacagtttagaacttaatctttaaattctttttgccttgaacttgaaaatcaattatctgtctgtgccccaccacctcttccctcatctcagccttcacgagataaaatttctctccctccggagcacatggtctctcaaaggggaagagtcacatctccttgtctgtgcagctgttgcttcgttttgtttagggtggatcttctctccttatccccgtgagtttctatagtattataaaggcccaataaggttctgtacaaagtgggtacttaaaatgtgtcctgagtgacaaactggcccccactggaagaactctttaaaacactctgttaccagagcttcaaaaagggcttgtttctgaaggatcaaaggatctcttgtataataaattctgagcattcagtacataatgaagagaagaaaacatgtcttttaagctcctatatgatgcctggattatgtgaagagatgaaggaagtggtgactctttctggcttttgtgtcattcacattaaacaggaatagatgaaagcaaaggcttaacactgacaaaatcccaagtaggcaggctctgcatccacagcctgttcacacattcataacaaaccaccagctgatgacttgaaaaaaatatgattttctttctagtgaaagactgactttgttttgtgttttgtgccttttttaaacatctaccttcagaaagtataaaccttttttttttttgacagagtgattgggttacaatattgttacagaaggactagaattagaatcacaatacttgggtgccacacttgacctttgtcacttgttatgtatgacactaaggaagtaatttagtctgtaaattaattttatttttcatcatttataaataaacctagtaaaatgaacatgaatagttgtttcaagggtttaatttaaaaatcatttttgtattgtggtaaaatgtagactcttatattcttataggcagattgcaataaaactctactaagcaattacactagattttatttctctaaattaaggctgaacaatctcttttttcagttccactttgtctgagtagtttgaatggcccagatcagagatgatttttgagactgttgttattgtgtttgatagattgtgctcatgaaggcacgtgcatatttatggagaaagaatccttagctttccccagatgctcacatgtgtttgtgatcctaatggggttaagaacccttaacctgataatctcaaccaattttcctttcacattaagtgggagtcctactattttagtattaagtaccagaagggtgaattttatatgttactttatatttactatcggttttgtctaacaggaattttgtgcagtaaaatatctacctttcaaattccctgggaggagaaagacaatgcatactggagatatgaacacttttccacaatacttataaaaaataaaaataattaccttggtgatttcccataattaaggcagatttttttccttcctccttcctctcctctcttttttacgttaacaccaccaccctcatcattaccactgccacttttctctcttccccttgaacagagtagataattgcatatgtacaatttcctagagaactgaagcaggcttagcccatagttgaactaagtttcaaagtttgcaaagtaagactggattaactatattttctgctaagtgttggttttaataaaaaaagaagtttatattcattgaaattttcagttgggagtacatgttttaaaaccttatttcttccttttttttttttttttttttgagatggagtctcattctgtcacccaggctggagtgcagtggcacaatcctggtttattgcaacttctgcctcctggttcaagcaattctcctgcctcagcctcctgagtagctgggattacaggtgcctgccaccatgcctggctaatttttgtatttttagtagagacggggtttcaccatgttggctaggctggtctcaaactcctgacctctggtgatccaccctccttggcctctcaaagtgctgggattacaggcatgaactaccacacccagcctagaccttatttcttaatctctgaatgtgtttggtgtgacactcaactatactttcagcttacctagcccaatataaattttattttaatgaatggtttccaacattttgactctcctcatgttaaaaaatctctggatttccttatatttgatttctgtacttatcagtatttggcaggaagacaagtcatggcaacaactgatggctgacgagacgttatgcttggaattcgtatattcatctccttaactgagaaggttttggtgtctaccattactgacctcactgtgaggaggcaccggagaatcatgatctcattctgtgtattggcatgtcattacacattattaatttggtcttttgagtgacacaactgtttttgtatatcggtgtgtttgtgcactgtccctggagctctttgtactaagttatttttatttcattttcattaacaatattttgggaattgtcattgaatttgtaccttttctaccttgcactttacaataattagcatattattatagtaaattagaagtttaataattaaggtaacatttagatcctgtcaataactatagcctactttattttttgaacgttttactatgcccctttgtaacagttttaggttttttaaagagtcattagagtcacttatttatgctctgctgattagctatttattttcacagttttacaagttagatgttcgtacttagatattttttacagatcgaagtttctatttgctcatgagtagctataaaataataattatcattaggttagatattttctgtgttacagtttgccatttatatattctcattgccaccctgtgagtgaaatgaatcagaggttgttagctccagttaaaaaaaaaatgaagaaagagaccttcagagaggttggctaaatggcttgctagtaagtgcctgagatggtgctgttctgttcatttaactttacattttagtctagaattttctctgttactccacttccttttctactcaaagacctttttataaaagaaaccagggagcacttaaaatttgttctctaagtttagagctggactcaaaccattactggcaaaatcaatctggtcctttctttcctccttttttttttttctttctctcataatgaatcaagacatccagcatccttgaaaccttaaaggtatctgaggatacaaagataccaaactggagttatcttcctgacacataaatctgatcttgtcatttcttactacaaatccacgatggtcttttacaagataaagtttaattatctgagcatgacacctagggctcttcacattctgtgcgatccaacttttcagcctcgtctctttttattatctattgcttgcccttatacacctcatcttcagcctccaaaatttcatgtatcttcttgactgtgccctgctcttttaggtttctgagttgcctctcttgcttttctataccagcccccaaccccaacaggaatgccattctttcatttgtagcttgctaaactgggtcacttacctaaccaaataactatgtggctttggagaaaatactgtttttatttcttagcttgtttattttgatgtaaaaaaatgtaacgcatgatcattaaaaatatatctattacattaagtcatcttcaatttctgcttaccactttcttcccataaacaatggtagcaagttgatgtttttctttctaatgttatttctcatgtagacattgatacatagtatttttcataagagcaaaattaagctcacattctataaaaaattttgtagtgctttatttcacctaatattatacaaagtctcagcattcaatattctttaaaaacacaactttttaaaattataaacttttctaatacataactatattctacatatttaattatttctctattattgggcacttaggttgtcacccaaattttattgttataaattacactcagtaaagatttttccattggtagttggtgatatattaatatgtttaatccaaacttagttagatttctagatctgggcatactggccaaatgaacataaaaatctatgttagaatatttaaagaagtcaaaatgctcataatattatgtagagataaatagcatatcatttttacgtatgtaatgtattcatacacatatctgtatgtgtgtatatgagtgtagctatagcactgggtgaatattaatatatcaattgaggaaggaaatacactaaaatattattttacagatgatgtccattttattaggtatatgtgtgtgtgtgtatatatatatatatgtatatatgtatgtatgtatacatatatatttgtattttaccaaatatctagagtgagaatttgttacttttagaataaaacaaaactcccacaattatccaccttaaccaattgctgtctcctacaaatcctttccaaccagacttcatgggtagaaagcgagtttctgctggtgaaagggtgaaactacttgaaaattatttattgtctcccaaggttcactgcagcatgagacgttacgtagttatcaagactaaaatacaaagacagccctgaaaatagctggggagtgtgaaaattagtaatatttaaagtactgaaaattagtgatatttaaaggaaaacagaaagtttagctcttggtttgctttgggagaggacgggactctgaagcccccatgctggtgaggcacggatcttggagggtggtcagaggttgaaagccacttgagcaaatactcagtccaaagcagcaggtgcaatggctcaagcaggaaacagagtaatatcctgagattggctatgtttagacaagttcctattttggggacacagggctccccattcatgggtgtgccttgagtgcagtgccagacacagaatagtcaagtaatatgttcttggatgaataaacaaagaccctttgtacaatgctctgggacagaaatgcttcataatagtgatgttaacatcttttcacacctaaataagcctaaaagacttccaggcagttttcacatgtatttcagtgtgacttaatgatttataattctttttttattactattattattattattatttgtaattatactttaagttttagggtacatgtgcacattgtgcaggttagttacatatgtatacatgtgccatgctggtgcgctcacccactaactcgtcatctagcattaggtatatctcccaatgctatccctcccccctctttctaaacattattaaaaatatttgtgtcactaatcttgcggccataaagaacaagagtttgctttaaaggtgtactgatgctgcgataacacctatggcaatatttaaggttatcaaaattataaagctccatcctggagaaatggtcatgtgacattaggcaatatgtaacttcttcatgccttagtttggtcattgttaaatgaaggacattaaaaaaaaagcaaaaccgtatctacctcatgggttgtaaggataaaatgagttaataaaatgtaaagcacttaagagagtgcctggcctgtagttagccctgtataaatgtatcccattatcattaccaaagaagcttgacattggtattaacttgcccacaattaactggtgtgatcaggcattagttcaaggtggtatctgaggttactatcagatacattttggactatataggaaaacatagtgcttctctataaattgtttgcagaattactaccacaaattttaatggccttctacttccaggggaggccatctctatttgcattagaaagtaatataaagtcagaactgggtcctatttgagatctaaaagattatctatttgacttattcttaacttacaacattgacatttttgcttattgctttcaagactgtttcaaacatgatttctttcggtatactatctttgacagtagtgagaaaacaagagatgcctctgccgtcatactccaaggtgggaaacagaggactagcacctccagaagagggcctctggcttctgggaggtggggcttttaagtttcatgatttggtattggtgctgggatctgagttttcaggtttgactatgcaacatgcttgaaacatggcctcaaggattgtttggctgcctcagcattcatggtgggaagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctgagtgttactgatatcatcaatcagccccaggtccttctaggtcagccttctatagggaagggaagtgttcttgagaatgtgtcttggttctccatgatgttcttggacagtagcaatgaaatgcatatcctcatttctatgaataaactatgcctgcactggccaaaaatgtgtctctccgtttttggaagctatttatttctttaacatatatgatctattatagtaatataattctattgtgtacgatttgccctcaatttatttctggaggatttcctgtcttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggcaaaaaaaaaaaccttgtaaatagcattcagttgaaattctcatgtcgtggataaggattctgaggccccagttagttaggaaacacgtcattaatagggagtgttactgacatagcaaggaatcaaactcgttaggacctctgacttgccttggaatgttctttgctgatatctctctattacgctgttggcttctaatatggtttggctctgtgttctcacctaaatcttatctcaaattgtaatccccatgtgttgggggaaggacctggtgggaggtgattggattatgggggtggtttcccccatgctgttctcatgatagtgagtgaggtctcacaagatctgatggtttaaaagtgtgtggaagttccccactcactctgtctctctgctgccaccatgcaagatgtcccttgcttccccttcaccttctgccatgattgtaagtctcctgaggcttcccaagccatgcagaactgtgagtcaattaaacctcttttctttataaattacccagtctcaggaagttctttgtagcactgtgaaaacaggctaaaatacagcctcctttagacagttgaatatagcttaaaaatagtaaaagactgaggtataatcagtatggagtccttttctcaaagtattttagatgagtgatgcaataagaaagagggtctactgtagataaaggcacaggccttgaggttacacacattaggttcgtatcttggtgttgacatttattgtcattgtaactttgtaaatcatacctaacttaattgaattcgtttaatcttatgtaaaattaaagttagtggtacccacattaaaggtacttgtattacgtgagattatactaaattattaaatatgacatctgacatataatctgtcttcaactgatattagaaaaaaatcacatatgatgtttagtggagagtcaatatctgtgatttagtaaagaaatggtaaaactcgtgatcagaaataggggctatttctatttagaatgctctttcagaagtattcttagaaaaagttgaacatcttcacattgcctatataaggttttgctgataaataattcccaaaagccaacattaacaaagtatcgtattttttctagttcttactttattgtacatcattttatgttagacatattgaagaatttctgtctgtgtgttcatttttgcagtactagtagcttataacctagggaatattatgtgcctcatgtatcattttcctttttaaaagatacagtcattcaaatttgtattgagtattttggcacacattttgagggtctgggcctccatgatttgaatcaagaactgattcctttcgggtaaatgttagctgatgaccaaaaaagaggtattttcaatcccagtttcttaagaatattgacctaaatattgactaaaagctgaggtgctcacagccttttctagcaatttaaaaaatcactcaaaacctccagtgtttaaagatcaattgagatcagatacattttttaaaggaaaaaaaataaaaaaaatagccagttttgatctcaaatgcatacacatctatgtagaataggcattttttgtcaacatatgtgtattaagcaaccaatatttggcaatctgacagcaattgtgcttgagtactaggaaggcaaaaattaataagatcatttttccccgacctggacttaaggaactcaaaatcttgcataaaacattgtaaagaaacccttttctggccaggtacagtggctcacgcctataatcccagcactttgggaggccgaggtgggtggatcacctgaggtcaggagttcgagaccagcctagctaacatggtgaaaccccgtctctactaaaaatacaaaaaaaaaaaaaatagctggatgtggtggcgggtgtctgtaatcccagctactcaggaggctgaggcaggagaattgcttgaacccaggaagcagaggttgcagtgagccaaaatcgcgccattgcactccagcctgggtgacaagagcaagacttctaaaacaacaaacaaacaaaacaaaacaaaaaatcttttttttttgtcttgtgagaataaggcatgtagctgctcacacatgtagcttatatagcagctgtcaaggttcatatgctaccacgtggggtactgtgtgatttcctcctgatggctgagttgagtggggactgtcaagtagggggaacccggagactgatctcaagtgtccctcccggcttcactggacatcatcaatcagaacagtgatgtggctgctgctaccgcagctgccccttgcttatcacagagcaccggctagatctcagcctagtgctaagcaatttttgcatgttagtaccattcctccaagccattctgcaaaacagatactattatcccttatttaccaatgagacaactagagttctaaaaggctacttgattagcttacgatcgcacaacaagtaagtgcacacttgctccgttttcagtctgtctgtcccttttttctctgctgcagcatctcttttgacagacactgtggtggtaatgtgctccctcctgctccatgaagctatgacattcatacttgtgactgtaaggtgaaggaactatgaatactactattaattgatatgtgtagctttaatgcattcattctttaattcatctaaacagtatatatataaaatatatatattttaaaattattttttcataggcttttgggaaacgggtggtatttggttgcgtaagttcttttatgctgatttgtgagattttggtgcactcattacccaagcagtatacaatgaacccaatttgtagtcttttatccctcaccccactcccaccctttcccccaagtccccaaagtcattcttatgcctttgcatcctcatagcttagctcccacttaagagtgagaacataggatttttggttttccattcctcagttacttcacttagaataatcgtctccagctccatccagggtgctgtgaatgcggttaatttcctcctttcatggctgagtagtattccatcatatatatttaccacaatttctttatccacttgttgattgatggacatttgggctggttccacatttttgcgattgcgaattgtgctgctataaacatgcatgtgcaagtaccttttctgtgtaatgacttcttttcctctgggtagatacccagtagtgggattgctgaatcaaatggtagagctacttttagttctgtaaggaatctccgtactgttttccatagtggttgtgctagttgacattctcaccagcagtgtagaagtgctccctttccattgcatccacaccaacatccactattttttaaatttttttcattatggccattcttgcaggagtcaggtggtacagagatgtagttttgatttgcatttccctgatcattagtgatgttgagcattttttttcttatgtttgttggccatatgtatatcttcttttgagaattgtctattcatgtccttagcccactttatgatgggattttttgtttttttcttgctaatttgtttgagttccttgtagattctggatgtcagtcctttgttggatgtatagattgtgaagattttctcccactctgtgggttgtctatttattctgctgactgttcattttgctgagcagaagctctttaattaagtcccacctatttatctttgtttttgttgcatttgcttttgaattcttggtcttgaagcctttgcctaagccaatgtctagaagagtttttctgacgttatcttctagaatttttataggtatcgggtcttatatttaagtccatgatccctcttgagttgatttttgtataaggtaggagatgaggatccagtttcattctcctacatgtggcttgcgaattatcgcagcatcatttgttaaatagggtgttctttcccccactttatgtttttgtttgctttgtagaagatcagttggctgtaagtatttgggtttatttctgggttctctattctgttccattggtctatgtgcctagttttatacaagtaccatgctgttttggtgattatggccttatccaaagagtatatattatgttttattatggtgccaggcagtgacattggtacaactaatatatgcccttatggaactcaagatttcttatgttaaatacagaataaaggaagtaggaatatttatagctgttaggcctttagttaattttgtctagatggagtttcaaattacttatgatttgttgtcagttcagtgcataaggagaaatttatcttataaatagcttagaaaggagtcatgtcataaaatgacatgtctcaaaatgtcttgtgaagccaagttttcttccagcatggcaagcaatcaccatttctcttgctgagcatctaatgaagtcataggtttgatgtagagggtatgttgtgtgaaaagtactactttgaaatattagataacttcagagtcacaacatgctcatattcagaaaacaagtgaccctgacttccgctgatccgcagctctcatattacaccagccatgggtaggttgtttgctgagtgtaccctcataacccagtttttactgtatcttgctcttcagcaagtgctgtttctccttccagtatacttctctctggtttttttttttactttgcctcaagtcagtagagtttaatttaactagtttttttgtgcatatactatattttctttcagtcatactttttaaatcttagttacaaagcacacaaccaataaggacccaaatgttgtttcgccttaaattactttctttttaatattttctttttaatattcctctccattcttgttttacatttggtgggtatatttatttgtatctcttaagtaaaagaaactaagggactttgaaaaaaaaacaacttttcactaataacagagaataagtaagacgttagtatctatgtcaatggtggtgagggaaagggtaaatgctttctagagtaaataaattcaaaggattgtatgtcatgttaatataacaaaaacaaaattagaaagacgttttcttagattatagtagtgtattgtgtatatacccttatctaatagtgtttgagtctatccctccactatatgtatatcctaaattgtacagagacactagtatgctaaaatttatcataagaaaagattaaaaggagagaaatgtttaaaaatgagatgaaaaaccataagtacatgtgtgtgtatgtatatatatatgtgtgtgtatatatttccatatttcttgtttcattctaaaggatggtctgtgcatctctttccagagatcatgcacctacaacatgaaggaatgaaagaaaacctaataatacagagactggctgagcgcggtggctcacgcctgtaatcccagcactttgggaggctgaggggggcagatcacgaggtcaggagatcgagaccatcctggctaacacggtgaaaccccgtctctactaaaaatacaaaaaattatcccggcgtggtggtgggcgcctgtagtcccagctacctgggaggctgaggcaggagaatggcttgaaccagggaggcagagcttgcagtgagccgagattgtgccactgcactccagcctgggtaacagagtgggactccatctcaaaataaataaataaaataaaataaaataaaataatacagagataattcttcatttacaataaacactaagaacacatgcacacaaacacacacacacacacagagagagagagagattagattagtagcaaggaacttacatacatgattaatgtgaatgccttctgaaccaaagctgaaggaagcagatgagagctctgtgggcgtaggctgctgctgtgagcatacaaataagtttgatcatagctacagtctccatgcctaatgtcaaacaactgtcttgaaaatcctaagtgagagtggggtgggtaattcagcacaagtactgatctctgttgtcatgaatgtccttgacagtggtaagaagtggggacccattgggaagagccacctgaggtggcttcatgacatgatggattttgaagagatgtcttagacagatctaatgttagaacaataaaagtggtaccatggctgtaggagatcctgaatgcatgacattctttatcactgggataaagaacattctagattaagtcatgtaacattcacctcagcaaatggaacagcagggtcagcaaatctcattttgagtcaacaaatgcaaacattgcattatttcttttccccactgagagactgtcgtaacacacataggatgctggacacagcaacatgggagccaggttctgtactcttctacttaggtaaacttctgtcagcccgcagaagtcagtgaacacaattatattaaaacaatgtgtaccatggacccattggtcagaagccatattaaatgcagtttcatgcatggttagtcatccataaacatttctgcttgtaataataatgcggtcagaagtaggccttgtggggctgaaaagaggttactaaacaaaagtattaaggacacagtctgtgcagtgtgtcacttggtcaactggaaagcagtgacgacttttcttatacttgccagggtggaattcttctcagtgtattggtgtgaggttctctccggaggcattgcaatctgtttctaactacttggcaacagcttttggaataaggccaaaaagattgtcaaataatacacagagtggaaatgagctgtttgaatttttcagccatccttccttttcttagggccaaagatgtagttttataaatctccttaattagtaatttctaccagaatgagttagaattattacatggaatttagctcttctgaatgatgttcagtcattaagttatgacagctggtatgcaaaaaaatgttgacttattccaatcgttctgatgcctaatagaaagtagagttttttaaaagcatgttcatgggatggcattcaaaaacaagcttaagcaatctttctgagattgggagccaatccttgagacacctgggaatgaacagtaaaaggattggatatattggttgaatcagtctcctcatttcacatgttgatgttttaagagataggcggcttggcaaaccatggtgagagatgacctcttgagttgaaggcttatgttcactctgtagttcagaggtctgatctttcaatgcttcctgacgaagctctcctcgttttggtccatatcgttttattttgaaagattagtcacagcatcagacagatgcaagtagctattgtgccagacaggtcaggagaaccgctatgtagaaatgcttacagttgtggtctgttgcaaaatacgtgaattcatgagagaagacacatcgataatgttttcaatgagaagtgtaattacgtggctgctttttgcatgcctgccctctctcctccttttgttccttgacagaaattcgcaggaccccttttttagcaacagagcaatactatagcttaggtatttgagtggaaattttgaggggtgtggggagaaagaaaaattaaatccatttttttaaacagaaaatgtaagaattaatttaaaagtgactcaaatgataattgtttccaaaattacaactttctaatctatccctaggtgctgtaaactgcaaaccataatcctgtcttaatactgcaaacaaatcatagtggaactaaggggaacttaatttactggtaagagtattttccttaatcagttgttttatgcatttttgattgtatttaattattgcagtacatagggcaggagtcacaaaagataaggataaggagacgttgcagaacttttgtcttcactacggtcttagcgtagatatggaccagatatatcatatagtgaaggttttttttgttttttgagttccattaaattgctggtttatttttgaaagagcaaaacccttaccttaaagttatttttcttgttggctgacctgttggcatatttgaaagtggcatatttataatatttatcaaaatgtcatttttaatagaaaaaaatagtttcaccactgagatttgagaaggttgacttctaaggaggcttgaagtttcagtgagaaaacctgtattttcagggggttaacagagctcacgcttcatagtctgaacgacttacagcttcagtcactgttccttgaatttgaatccgtttgaaatctgacctgaatccttgattggagttttttcaaattctttgtgcaacaccaagctgaattataactaatttcaaagagtttggaacaataagaaaagttcacattggaaggagggccaaacacacagtgatgtagttctaggtaagctgtttagctattttgatgacccattttgtaaatcataaaactggaataatagttgtaactgcctacaggtgcagcctaaattagattattacgataatgaatattagcactgggtttggtccatagcattgtgtttggttcagtaagtgccaataattagtatcacgactagtttttaaagacaaaataattggaggaaaaacaaaaacgagtaatttttttctcaatgatgaaagaatggttttcttactttctcaggagcacattatgtcaccaagagaatatgcactccagaagaaataagatattacttggtgcatgaagaatttttttctatgcatttgttgcaaatgggaccttaatacaaatataaaataatgaagaccatgtggaaagagatagaaaatcttggctttatgggttactgttagcatacctggttcctggtaacccccagcggccttctaaatgaatgcaggccataccaagaataagtctatgaagaaactctctgtgctttgaaaaacatttgatctcttctctcatccactggagtggttttgccctccactatttttagatcttcacttgggaactttctccaagaggggttctccatacagactttctaaccacagggcatctgaaagtctcttgtaacattaaaaatggtttgaagtatattctaatatccttagagaaaactcttcccaaaacctgattaatcaattcctttgatgatgattgtgtgggatacatttattccattaaaacacttttatgatttcactttaaatgaatttctagttcataagaaacataggtaaatcttctgagatagtaatgaacaaaatacaatacccagggtattaaattttaaaaaagagattatcatactactatgagaaactgtaattgtggttgtgtcatgatgatgtattaataattatttctcttgacattatgaaaatggatggtaacccgcaaaacacccttcttgctcgtagccctgcattctttcctgtattttattgaattatgtttatttcttgtgttcctcttggtgattgatgaaatcattatttaattctacaaaataagttcccttaccgtcagttttcattgtgctagggaaatcagccatcaggttccaggaagggtttgtggaatcgtagtcataaaacacccatacccacacccacacacaaacacgcatttacctaatcttcatttttcttttcagaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaaaagtttcctctgtccctctgtttttgtttgtaagattttaataggctcaagctcaatcttcatagcctttttttaagttaattttttctttctttccaaattcagaaggcagattcatttcatcaaaagaaaacagttcctcagttgctactgcattgcagagaaaagactgactataatcaccattaaattattaaagaataaaagatactgaaacccagcaaaacttgggtgatctctttcataagcagacacttttaatcttatattgacatttaaaaggactgttcaagtagcaacatgacagactgcacatataaaatgtccatgaaaatatgtagcacagctaaacaaataactcagagcaaaatccaatgaaaggagaaaattgtgtttcctcaagaaaatgctatttttgccctaaggcaattcttgctggagaaaaataccatgtaaaacattgacacaaatcacagacatctcttctaaacagtggattttattggactgcacacgcgtgcagagatttggcagatatttgaggtcttggaaaggaaacaaaccagcgaaatatatcactattatcaccaacacaactgcagagggcaaagagcagacacatctcagagcctagtgatgaagcagggcattaaaaactaaatcaaagcctctgatcaaaggctaatttagtctgtcataattgacttgcagtggaaggaagcctcatgcacaaagatcaaagattagtgacttcacatttaccacaacatccccaccctaaaggagggaaaaaaatcagaaagaagaaaggggaaaaaagaagaaacatgtcaaagctcactaagaaccctgtgcaatgtaatctacctttcttaaggatagcatgcattattagaaaaatgaaaatgaattttattatggcatgtttgagttctaccttcgaaagagtgagaaactggcactattggcttaagtaacttatttgcaaacaggcattattaggcagtgccttttgctgcagttgcttccctttatttgtagcccttcaaatgcatacattaagattctcttcacagttgcaaacagcaggtaaataattgtatatttgagagactattgcctattgaatttaagttggtcacagactttggtccatggtaacatactaattgttaacttcctgttaaccagttatatcaagccttatgtaatttttgttgtttcagtacatactgtgaatatagccagctccctaactctgtatgaatattatatggggaggaaaaaatcctgtttctctattcttctaaaatctgtacctggggactgtgaattaaactaacaaaagacagattaataggaaaaaaaagcatactttttttttttgagacatgtctcactctgtcacccaggttggaatgtagtggtgcaatcatagctcattgcagctttgatctcccaggctcaaatgattctcttgccttagcctcttgagcagctggcactacaggcatgcatcaccacacctggctaattttttatattcatagagatggggtcacactatgttgcccaggctggtcttgaactcctgagctcaagcaattctcctgcctcagcctcccaaattgctgggattacaagccacaaattttatttgatattagtaatttaatttttacatgcggagaggatgtcatagtaaagaagtgaaaatcaaaaaagcaattagaccaggtttgtatactattttaactaagggtgataaattgtgtagaagtgacaagacaaaggaaaagagatttaggcttctaggagcagttaattgtgagaagttaagtatatgggcaaacctagtggaagattagggttatttttagtaagatttgtctgtgcagatctatctcagtactgagtttctatctccagtgatagtggttgtcctcctggtacagcagtgggaacggggaagaccctcacaaaaggaagtgtatgtcctccttttaggcctatagtggggaggcaaagagctctttctgtgtttgctgcttgctgactgccttcagctcaaagtaaaccttattgccaaagtggcatattttggggtgtcatattctgatctctttcagttcctatttattatattctcctgtcattatgctttgtatattttatgacattttaaacctgtgccatgtgtaaaatgacagtgaaaaggaaggtaatcctcttatgaaatgtctttctagttgtctaattatagggtgccctattagtttgtaggaattaagcattttcaaaggcatttattcaacgattgtttttgtgtggctgttaagagccacagggttgaagatacagtcgcaaagagagacacagttcttatcctcatgaagcttataatcttataaaggcagatatgttattcaagttataatgcaaacaaatgtaaaattgctgctctaataagcgccagaatatggtgatttgacctgtggtggtcagagaaagcttctctgagcaacaaatgcctgatcagagttgagaagtaaactaaaccagaaagtaagactagaaggatccatttgattgggaactttattagaatgctttcatttttcttgagatagatgtggaatccatctgtgctggggaggtaaaaaattagtccacctctcaggcagaggacagacagtgctgtagataatgcactgagaatggattttagttccagaaaaatatgagttccagctttaactcagcaacttttcggttgaagatttggacaaactagtcaacctctctgaacctgaggctgctaatccgtaaagtgggctcataatccttatctcagataatcatctcaactactgtttgttatcagtgtcatcaacatagtgctgatttgcaatgtgatcttaggcaaaccattttatctctttgagtttcaatttcacacttctttaaaatgggggatgttggattaaatggtttcaagatttctttcagctctacatttccatgattttgcaagcaaatgtaaagctggaaatttctgtctagatatcatgggaagcctatatcctggaaagttagaaaaagtgttgtttttggaaagtagactttttaaaagaggcataattccacccgttagcgattttacttatatttctttaatccacacttagaagtttctattatcttagattcaattttatagcacatatttcttctactaaaaagcctttaaagtgtttcagtgggatgtttaatttcccattatggttggtttctcaaatcattccttttgtaattgtcacatttttacagtcctgtttaaaacaaattcagtttttcaactaaaaatatcaagctgagttggaaatcgaaatccaaggactgcaaaatcaaatgataataaaccaaccataaggttaaactttccaaccaccacaaacttagagaccaccagaaatttgtgttacttgtttcttataaaatatagaataatcttttgaagattcttgtggccaaagtaaaattttattacatttctaaatctagaaaagggaaaactatttttaacaccttgttacttatttaaacataaaaatatttagtttgattggagcctcttcttgactctattcatatttcacttaaattactattgttttagctatacaaagcctgcttctgattatatttatgttaaacatttaatctttctttgtagagccacagatttaagaaagcatccagatatatatatatatatatatatatatatatatatatatatttctattttggtattttaaaatctcactcatgttttgattaataaatattcttaagtgctttcatatttatctttatttttaccttaggaaacacatattgaatatattaaataggtataccaggtgctattgtccttacgttataggttagaaaactgggccattgatttattcaagttcgattgtatatttatcgagtgaaaattagatctcatatctcatatcttctaacttcttattttgcattgccttactgattttccaaggtaaggaagaacctacccaatcaaatgaaagagtgctgacatgaattaaatctggttaaatgtctgatggtctgattgtcctcaatgattatagcattcaatggtattttattttcatttacccttccatttgtttcttataatatttcccattttgttagcctatgtatagatacgcttttcattagtgaatgtccaattatcatgctttcattttgggtggaagactgattagcatggattaattaaggtaattaaataattatagttactgtaatgtaactatatagaaatgaacattagcatggcctaattatctagtatttaggaacatatgctttggagaggtgatttaagtgggcttgaatttgaccttccatacttactagtaatgtgtgcttttacaagttacttaatctttatgagccttaatttctcatcagtaaagaggagatagtagtccttacagagtttatttttaatagacacatttctataattgtactatattttacacatggtaaactctcaatattatgattaacaatgcttttattgccctagccatggctgtgatgtatctcgttatgaaccaattatgctcccttagcaccatagttatagaggatgggacagttaatgcgagttaggttgtttagagttcttctctgaggagttattgaattgatgctgaagtaacagagctggtatcagagaattataccagtacgtaagcaagaaagaaacaagaataagcaagaaagtctcagaggtgtttgggtttctggatccaggggtccctgtagctggttccctctctaccttttctgtagtttttgtatgcgggccaataaagttccataacttgttagtttagcttagtttgatttgggttcctgtgacccactaatgtaatccaataatacaacatcttaaagacacatttctttgtcttcaagttaacatgtattactcacaacagtatcttaatacttatttatttatatgtttattttgtttctcccaattactaaaatgtaagctctatttgaacaaaaacttgcagtactctttcttcagctgttggaaaacctctaccacctactaggttctcagtaaatattggacgaataaatggataaaaagagaaagaaagtgacacttttctaaaagtgctcctgaattaaaattgcatctgtatttcttcctgaatagactagaaaaggacacaaatttaacatttattgagaacttacactgagctagccatcatgttagatattatatacattttgaacttgatgatattatctccattttacgaatgcacaaatggagggacaaagagctaaagtcaaattggtggcctcctggttctctgctcagaccgacctttgagaaccagctgcttccccagctgctgggatgtgtccagtagctagcacttaacatgttagccctgctttagggattgcctcagtggaagagagtactcctttgtgcaatgtcatgtcccctttccagggaagcccacatctaatgcctataaaggcccaacaccatcagctcagctctggacaactcctgcttccgaacacccctttcccataaattgatctcacatccctcactaataaacaagactcttcttcccagggaaaccaacctgctatggtaattttcaaatatctctgcccaagctagtgacatggcctctctaaggaggtaaagtgggctgatacccactgaaactgggagaagtatagttccaaggtatgatctgagaaagggctaggtattttctagggtcttaaagataggttttttagctgggatacagggagcttgtgatgagatgattgtcagggcagcagacatcagactatgcagggccttataagccacgtatcttggtgcttttgtgctgctataatagaataccacagactggataccttgtggatagtagaaatttatgtctcacagttctggaggttggaaagtccaagatcaaggcatcagcatctggtgagggccttctcgatgcttccttcagagtggaggtagccatgcctcacatattggaaagtggaaaggcaagctagctaaatcctgcatgaagcctcttctaaggcctttctgagggccttaatcccattcatgagggaggagcccttctgacctaatcacctcttaaaggcccaccagttaatactatcacattgaccattaagtctcaacacttgaatttgggaagggatgcattcaaaccctaccatcatgcaaagaagccaaagttatatttcctattgtccctaccctttcctcagataccaggatttgcctatctccatctctagctacaattgttctgaattttggggcccgtttttgctgcatgaatttgtatttgaattcaagacttgaaagattaattttcctttcagaatgttattcatataccccttcattcttaacctgctcactggtttcctaccataattacagtctcaaacagtggttgcattctggcaaaacgatgttttgagttagagttgttatgcagttagtcagttgtttgtagttaaaaagtctctttcttattcactgaaatgactggagtcccagctgctaggattcaaaggcaacagggaagacttcctagagtttcatgtgatcataaaaacctttccagacgttttaagtgattatgatttctatgctgcattgacttacaattagagatcattcaagtaacttagaattcagtaacttctaggtcacagagaggctcagatacacactgttgacagccttttggtgtctttgtatgtgtgtgtgtgtgtatacatacatacacactaaactgtactgctgtatgtgtgggaaaaagtctaaatactaagcatttttattctattttgggcaagtatctgtgctcaatggatgcaagttggtatctaaaatctaaaaaatgcaaagataaatggatcatctgtgtacttcaagctttattttcttgcatagttttttcctagtatttcctgacaacctagaacagtagttctcgcctttgactgcctattgccattgcccgtagcatattttagatctaaggatccctggacagatactctaactcagtggatggagcccaggtagctgttttgtttgtcgtggtagttgctctttttaatgtctacccattgtcctgtaagacaactagggttgtgaaccatcggttttttacactatctaaaaggaaggtgtctgtggattgaggatatttcttaccttgcctacttccacactttcaactttctaaaattcctgggattcatgctcccattccccaaagaatagtgagttacctataattatctacagcatctatcaataatgcctttagttcctcactttgagttctgcttagagctaaacatattctaagcgaagtaaggaggtttcatgcttctgtgtatgcataagtgtgcctgacaaagagatgaaacatgaaagtgaaacaatactgataaatgaaatttaaaaatatagtatgactttgataggtagtctgtattctggcacttcatgaaatctccaaattattgtatattaccatagcatgcaatttttacttatagcatggtaaagcagagctcctccttttgagtgatgtacagctattgcaccactctaagtggtaacttaacacagaataaatatgaatagaattatctagagttgtacaactcagtacctttggtttggaccagagaaaaaggccttagagtagtggttttcaaccaggagtgatttcgcccttcaggagcatttggtaacatttggaaatatttttagctgttaacgctaatgagggagagacttgcacctggtcagtagaggccaaagatgctgctacatgttctgcaacactcaggacaactgaatgcccaaaaagaattatcttgccccaaatggaatcatgctgaggttgagaaactctggcttagagaattgtattagtcatcctggcccataaaattcccatgaaaatttgggaacgaggggaggattcatatgtatctttttggtattgtatttctggcgcctgggagcttgctcagcatgcagtagttgctaaatatgtttttggatgactgagtgatggcatgatttgaatcagacaacattattttaccagccttggaatctgggcaaaagtgggctgcttaggagcaaagacacgagtctgtgtatttctgtggttgcctttccatggaaattcccattcaaggggatacctaatatgtaaggattaaagatgcctcctccatggattttccatggtgtctcacattctctaattagttattccttaaagttttgtccacctgtgtatctttagtggtatggcttcatgtcacctcaaatatggaggcattagctttgtttagttcagtatataccagattatgggatggaaaatactgaagggatatcaaatgatcatacgtaatctaagatataattaaataataaacttacataaagcatttaaaaaaaatttagttctctttcccttaattctttcaatatttcaggtagagtcaaaggctggttttgtgctatcatgattttataactaatttttaacaccatctccttttcttcttttcttcttcttttttttttttttttgtgagacagagtctctctctgtagtccaggctggagtgcagtggcaccacctcggctcactgcaacctccgcctcccgggttcaagcaattcccctgcctcagcctcccaagtagctgggattacaggtgcctgccaccatgcctggctaattttgcatttttagtagagatggggtttcaccatgctgaccaggctggtctcaaattcctaacctcaggtgatctactgcctcggcctccctaagtgctgggattacaagtgtgagccactgtgcctggctctctttttcataaagagacagcaaacctcaaaatcagagattcagcttgccacaggtctatttaaaattgtttttatttcaattcatgtattttttatgtaaagtagtgttgatttcctgtttatagcagtggagaacatattaagatattttaatttaaatagaaaagtaagccaattacaaataagtgcaagtagcgtacagatatgaaaaaaatcataatcatgtcacttaaataggcgaagaaatcattgaatttatttgttttgttaacattgtctcatcttgaaggagaagatggaatctggagattgcagcttgaatggctccggaagaggcagcatgttcggtggattggatgtgtttgcataactgtgggaccacatgggaggtgacgcaggaaggctgaaagaggacagtctccaaaggagggagcaaaccttgaaaacacctgcagggcccttttaatggccaactgcatcaatttaaaacgttcacttgctcccccatggctgtctgtccaggcagaagcaacatgacctctggtttgaaaggcctctcagattaagagagaatattgtgtcttggggaaatcaatcatattattatgaatcatagaattatgagtcatgtgttataggttgtttcaggcaacaagacctcagatgtccttcacttcaaccactcttgggatactgaagggtattgccattgcaatctgtggccaacatctacttccacatctctccctcttggggctttcaagtccaagcttggagtcatgtttgtaggagcctcaaatctctctctcaagaattttcatttgttttccccagttctcccctgtggaaccatggaaattaaaatcgaaaccctgttctattactttcacatgtttgaagatagatttcatgtcttacttgagccatttttttcttcaagaaaacatttccagctccttcaacttttccgtccatgagataatgtcagtccctttttccatcttcggaccttgcctctgaataagctcagcttgtctgaatcagttttaaatagaagcatttacacttggatacaattttccaggtgttgcttcagtgggacaaacgaaagtgagacaattgcatctcttgttctagatatcatacttctttatccataccctaaggttactaactttttggcaatttcatcacattgttattaactaagtcccctttttttttttataaagaaggtactacaattatcacacacctttattttaaacgtatggcaacatctttttttttttttttttctgagacattctccctttgtcacccaggctggagtgcagtggcttgatcacggctcattgcagcctcgacttcctgggctcaggtggtcctcccacctcagcatcctgggtaactggcattacaggcacatgccaccatgcatgtcttttttttagagagagaatttcaccacatttcaggctggctttgaactcctgggctcaagtgatctgcccatttcagcctccaaaaatgctgggattacaggcttgagccacaatgcctggcctgcaaatgtctttctaataaaagtatgtgtatctgtagtgtgtgtgtgcacacgtgcgtgtgtgtgcttgtgtgtgtgcgtgcttgtgtgtgtgtgtgcatgcgtgtgtgtgtgtgtgatatagtgggggtggggcaggagataggaattgcagagaaatacgaacagttaaacataaagagaaactggaaatttgaaaatatatgaagtgtctgaccccaagttcaagctgagaagctaggcatcaattttatttttccttagcctgtttttaaaaaagtattttttcaaagtttggtccttgagccacttttcagcatcatcttatcagggaggcctttcctgtatgtcccattgcttgttatctcatccaccattccttgctatctgctttaccctgctttattatttttttcatagctcttattacttccaagcattttatatctttttatttatgtattacaaggcttcatgaaaggaggtactttgtttttttaccactgctatttgtcacaacgagtttattaaatgaacaattgaataataagtaaaaggctaacttgggatgtgattgcatattcagatttttgggtcccaagctgggcctacagaattagaatttctggtcatggggcccgtttaacttacttttctagtgtttcatctgtgttctaaaattttagcaagactgaaagtgcacacaatctcagtgcactaaacactgaaaataaagtgtaatgagtaaatttttgaaatatcagctgggcatggtggctcatgcttgcaatcccagcactctaggaggccgaggcaggcctatcactccagatcaggagttcaagaccagcctggccagcatgatgaaaccctgtctctactaaaaatacaaaattagctgggtgtggtggcgcggacctgtaatgccagttactcaggaggctgaggcaagagaatcacttgaacccaggaggtggaggttgcagtgagtcgagatggtgccactgcactccagactgggtgacagagtgaaactctgtctcaaataaataaataaataaatgtttgaaaaatcaaaaaatggccatcttcctttacattcttaaaggaaaacataagtctgtatcaaggcattagaatataattatgctgactgtatattttaagtcaactgcatattactggccaactggagatcactatctattaagacataaaatttgctataatgtaggtttattatttacagaggtaaaagggccttattcaaaccttgtttcgactatgatgatgtcatggttgaggattcactcccaggtcctaaataacattccgataccagcacgacagcagattcacacaggcacaggcacttgcagactgccatagcttaccaaacaagacccaggtagagcatttcaaaaagctaccaaattgacacagctggggtgtagtttgggaaatttgttcaaaatgctaatctttgaagttaaaggtggaaagaaaaagtctacataaaaaccttccttggaaggagaaactcttatttccctataaacttcattactaacaaaataagggaggagagcaataagaaacaaataagattaaggaagccaaatggtttttaaatgagattattttttctcagacttttccacaaggcgtcagcagctctgtaaccaccagattgtcagaaattagcctggttttttttggacagtttgagaagccattccgtcggccttatttattgtttattaaattgattctacttgattttttgcagacataaatgagattcttctgaatgatgacctaagctgttaaaccttataataacatcactagtcactacttctgcctctcagctagtcagaagggcacaccctatggctttacccttgatcattgcacaaaaagaagagccaagactgtgtaacccaagtgtaatcaaagttacataaaaattacttagtgaagccagcccctgatctgtttagcatcatgtttactaatttattttttttacctccaagtaaagtacttggtcttttttaaaaaagaaggaagaagagcaaaatagagggagggaagaagagagggaaggaagaaagaaggaaagaggagaagagaaaaataaaggaaggaaggagggagagagagccttctcaaattcagaaaataatattattttttctattatgaagcatcgtggaagaaaataaggccagttgctacttaaaagtaagcattgggctgaggttaagaaatcatattctatctttaaattttatattcactacctgtttggcctcaaaaagtcacaaactcattgagctaagatcttacttgtaaaatatatgaattagagctgaatgatattattgaaacattccagctttaaaaactatatggctctttgattattaatgtaactgtcagatttgaaacacaaagatagaatgagtatttagaaacataagccacagacttaacaaccagctctcaaaatcctctcctcagtatttataaagagaaataaattttgaataaaaagataataattgggaagtacaattgttactgattataattcaatcttcaatgttttactggaaagaaattgaacaatatatgttcttaataacttcctttagtcaataatcgagtttgggaatttttagcagcttgagtatatttaagcccagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcccagatctacacagtactcacagggcaggattcacacgtttaagcccagatctacacagtactcacagggcaggattcacacgtttaagcctagatctacacagtactcacagggcaggattcacacgtttaagcctagatctacacagtacttacagggcaggattcacacgtttaagcctagatctacacagtactcacagggcaggattcacacatttaaatgctaagggatgaggtatcaggagaggtataagacaacagggagtggtaaggcctggtacactgaaaaacaggattgttttaaagcaggaaagccttgctcaactctggaagaattttgctgtgtgccaaagcagaactagtcttgtcagactttctaagttttggaagaaaggacagaaatcagcatattaatgttaaaactcataatgtttaagacatgggagttcattcaagccttcaaagacatcactgtgcaaactaatcaaaacacacctgtgagtttggccccactagggtttctggagtttccttcctcccattcaactatcaggtgaactacaattaggtattaatccttaatgacagcttcctaatgaccttgtttagctatttcaagaggatccttccctaaagtattcagaatcgccttgaaacatgaagaccacttcaagtgctatgcaaagtgagggaaatttggagagtagattcttctgaagatttctctgctaaataagttgcactcaactgaaatccagatgtgccagcactgaagctccatcgcaggcaaggccgactcattgaccccaacttctgtccactcaagtgccccgagactgctggtgatttagcaagtgaactccttgccagttgtaagagctaattcaatctcatccccagggtggtataggtacattaagagttgcagctcttagagtagttaatccggaaaaagaaaaaaaaaagccaaagtgcttgctgaacatttaactgaaaaatttctcatttgtacctgatggttctgaattttgtcaactgtttctttgtatccttgtgacacgtttcttatttgtcatgttttcttttaagaaagaataatgtgagggaaatgaaatgttcatttgttactggaaacttacagtgatgagatgtggtgcataagacatcataaaatatccctcatttccatttgcatttgtcactgctccaaatcattcacgtatctctgtatctgcgtctgcatctagctttgatttattcacataattgatgtagagtgacttttcccaaagacatgaattatattaaatttttgatttgtgcatgtatttgcttttgcatatcttacttttagatttttatagctcttcgaactcagagaacattcaccacatctatattggcctagggaatgttgaaagaatgattttaattatgccacatatttttgcactgttcttatctacaaacaattgtataagctatgccttttgaatatattcatgtgctgtgccagatagtagtagtgcaaaatgctaatgttgattttaaaagaatgacctttccttgtgtgtttctttccagtgatctgcttatctaagacggatagtattgatggactgcactatcacagtcttagacttgcagaaatgccttggagttttttgtttgacatttctttgtcccttgggtactttgctctgactctgtcatttagactttactgtaaggataaccaattagtagttaaatgagttgaaggagtctttttatgtactctattcaaataacactaaactcactgtcacatgaataggagatatgaattatttctctacgcacttttaaagcaagcccacacagtaaatgatattgttcataacccctgcctttattgctttcttccctacacttagggacttattttaaagaagaatttatagatcctctattctgtattccagtagaaataataactcagtaggaataggagtatgtagttttttttaataaacatataacagaatggtagaattagttttgaaagccatactctgaaggaacaacaatgagaatacttgctgggaattcgcctctttaagaaatagcagaggactgccaaattaacaaaatgcccctggtctgtatcatttatacatggtacagatatatattgtggacctactgtgttccaaacccaaagattgaagaagtaaattctcacttcctgtctttgacatattcagaatttggaaatatttcggaagctagaagtcaatactcacaatctaactcttagaatgaatgatccttggtcttttaacaaaggacatctgactaataaaatagtcttagagttgtaggagaaatgtgtcattctggacaacaaagaccttctgtctctttcgcaatggactgtttgcgtaaaataccagcgtacttagtgaattagacatctacaacactgtgtaaacattcctttccagtcattgcttcctggtcagtcatagagaccactttgaagtgcctttattttgaacactaggaaagaactacaggagagccacagccctctgaagtagtaatttttgtaaatttgcgaataatgatgttacatcacgtcactgggacatcaaacctgtctaatgtgcactactactcccacactactactgctaaggcaacaaccatttactaggcttattggccgtgtgccaagtgctgtgtttatttcttattttcataggatatgttatttaattaacgggtagctaagagagagggttccagagacaaactgctaaggttcacattcttgcttccattatttgctagctgcatgaacttagccaaatttctcaacatttctgtgtctcaactaccttatctataaaatggaaatacttgcctgataggtttttatatgattaaatcagaagatagtggttaagtgcttagagtgcacagactaaatgttcaatttgctataacatttctataatatcactcaatgaatatttgctataatattttcatatctcttactgatcactgtaactcaaataattgtgctgtcttattattcttagtttgcaagtgaaaaactgaagttcacactaaccttttagtcaaaaaatgcactaaatttctgagctgaaattccaacactgtttgatctgattctgcagttccaatgggggatgatatgtaaagagaaggggtaggactgcacctgaaatgttactagaattctattcaatgatctgtgatcctcatattcattcaaaacctatgggtgggagatgtggggaatgggtgggagatgtcagaatttgtatttacagtgaagcagggagtttaataaggtggaatttcaaggtttttaaaactcgatggtttttgtaaggtgggagtggaatggagagtgaggtagtaaattgggataatcaacctcggagtctctgggatgggagagatttctcctcagtattcaaattctggaaaccttttgaacttccaccaaaaataacaagccgtctaataaacaaaccatcccatgcacagagaaagaaatggatggttggggctttgaagccagtggtggttcttagtctgtgtggctaacccactagggacagatggtattattgggggcagctctcagaagatttgtaaaatatggtgaggttagtagcatggccaattttgttgtacagtatcctcagttaagcatgtataccaggagaaggatccatctttcttgcactttgaaggatttggtaacttattcaggacttggtcctatagctgtggcagcaacaagagtagtcagctcagcttaagcctctgttcctaaaggaacttggtctaaacttgtaggtctaaagacctacaagtggctctgatggggacctgcagtgatgcaccagcgagcgacaaatggagacatttctttaacaaggaaagcgatacaatttctacatgggaaggatgcattggaagcaacctggttagaagggggctggggactcattttgaaggtctggctgcacaacaggcatcatgttcttacttagatttaagtttctttggaattaataaaaattatgagcaaactgactcctttcctgaggtacaagtttgctctgcggctgctctttctcttctgtgaaaacgtgaagctccagttttggtgctagcaacaacaggacagaggcttactttgcaatatgtctgatagtgattgtgtggttttcctgcatcaaagggttaaagttgaaataaaacttgcatttcattttgagcaaataaagcaagagcaaatggcattgtcctgagaaatgttagcacactgtagattcttaaatttattgtggttgaggatggatgctctccagattagcaaggcagcacttccaatgttcagtggagggcactttaagatgcaattatttacacttcatgttgtgatattacaacaatagttaataagagctggagagatttcctaattatctgagggtgcaggaaatcatttcaccctccccttacttgaaatactaggaatcaagtctgcaggaagctggctgatcacaaatcacgtgtcagcacctccataacatttacctgcataatttgtccttattattttttatgttgatgaatctatattgataaatcttgcatttatctgttttttgcagtatgtatttcctatttcacagtagtagggaccctacgctctatttactttgtgctctttcacagtacaccataggatttaaataaatgcctattgaaaaattcaacaaataagccatgtcatttttgttaagcagctttacttggaagcaagacttctgttcaaaattatgctaagatgaagagtctcaccatcatttccctggtgacctgtgggcacagaatttaatgagaatttgtttccttgccctcatagcaacttcctctgcataagatcctaattaaccaccataaggtgatttaggccttggggtggggtggaattattcattttcctctattttacatttatattttacttcataatactgcattcacttcctttgaaatgttagtattaagaagttttctagtagctgttctcttaaaattacgaggatttttgattttatgttattttattagtcaaaaactaaaaccaaaagcaaaatctgtaaaattccttttttgaggatgtaaaattgccttatacattatatctcattatctttaccgattttaaaattaacacctaattaaaccgtgtgtgtatttcaaacgtgaggctaggttctcattgatgctctccactaaattgttgcatgaagctcaagaaaaatgtgaaagattatacagtttttgggcaacaaatattctccctaagactcaagatgtgttttcttaagaaaatagatttaaaatgtgaactatttccaaaatataaagcaaattaagaagcattttcttgaaggagaaaatgtaacaattaccatagaaatgcatttgccttgatatcgtcatttttagcaatgagtttgatcagctttgtgttgatgatcaattctaaaatgattctttcctatgaaaaaccatgctttggtttcatttcacagctgctaatttatttacttcacatttgttgtcattatcgcattctctgtttattcttgcttcaaatgtgttttgccccgacacatgttcaatagatacaatcctttacataaaaatgaaagtagatttctaaaactctgtagtatatttacatcaaactgtgggtaaaataatttggaataataaagtgttttagatattatggcagtgatgaagaaaatgtattgaaaatgatgactaggccaggcacagtggctcactcctataatcccagcactttgggaggctgagatgggcagattatttgaggtcacgagtttgagagcagtctggctaacatggtgaaatcctgtctctactaaaaaatacaaaaattacccaggcacagtggtgggcacctgtaatcccagctacttgggaggccgaggcagcagaatcacttgaacctgggaggcagaggctgcagtgagctgagattgcgccactgcagtccagcctgggtgacagagcgggaccccatctaaaaaaaataaaataaagtaaaataaaataaaataaaataaaataatgactagcttatgctctcagtacacattttggattagatttcctacttcagttaatacaggtttcttctttccctcaatattattgcacatgccataaatatatcttgcaaaactgaataagaattaactttgaggcagctatacatcttatagtcttgttagcatacagaaaacaattaataaagaatcttcggaattatttagatttgagttcaaatcctgagttcaattattaggagttaggtttaagaaataattcactctacctctcttccagtattcgagaatacagggttaaaggcagagctcaatcagatggcaaaatattggctttgtttacacttccccagtaattatgaatgttaaagggtgttgagtgggattttgtattttgttgtagctgttgttgctctcaaattggtaactagagttcacagctgcatgcagagattagcctggtataccatttactaaagagagaagcaaaaaattatggtcagaatcctgtctcaggagcttcttaagagttgaaagaaaaaactcaatttccccaaccatcaaccagctgctcggcttgtgcacaaaaagttttggaggcaggaaggaggagagtagctctttgaaatgttctagcattgtggaatgtgcatcatttatgatcagatgggattccttctatagcgcttttctcatctcaagtcaagtgaagggctccaacttaatcatttgtacagactggtgcacgtgaaagaaggagacttgcaaatgttccctgtttagttaactgaatcagtaatgaacttccgaatctgtttctgtgccaatgttgggcagataggagaaaaatggagagagatggtagggagggtcagtggagcacctacattctcgcctttcagcccaggtggggtacatgaatgttctgtagataaaaaagactctctctctctatatatatatatgagatggagttctgctcttgtggcccaggctggagtgcaatggtatgatcttggctcagtgcaacctctgcctcctgggttcaagcgattctcctgcctcagcctcccaagtagctgggattacaggcatgcgccactatgcccagctaattttatctttttagtagagatggggtttcaaccatgttggtcacgctggtctcaaacttctgacctcaagtgatccatctgccctggcctcccaaagtgcacggattacaaggatgagccaccacactcagccaaaacagacccagtattaagcagctgggcttgagctgttgctggtacctcatctaagggggttggtaacaggctacagtgacaaaagcagcaagaggcagtgagatctccaggaagctggaggaaggtgggatgaaggtggaagtacctgagacctgtgcagaacctgacccagtagaggggccaggctagaagagatgtgataattccaaggtgctaaagaggaagggggaatcaaaaaagagacaacgctcttttattttcatttcagctccttccagccatagttctggccagaaatggggggaagggggaaatattttgaatcaaactgagttttagtgacagaaggtgacttgagatttatggaagaatcaaatgcataaaggcatgggaaaggagaatttggcaaaaaatagtgtggaaaactgtgtttgaagaaaaaaaatggaaatatttcaggccaatgagggtctttgataaaccagttacagctggattagagaactctatgaggcttcacatgttatttttcctgaatttaaaccctgggactcaatattatttctaaccaatcataggtagcgaggttgaaagggagactacagagacctgattggtgtttttaccacctggacctggaagcactgtcattgacagatcccaggtgtaggcagaaagggcaggggatccgggtgcaaaagaatgagccttgccttgtttttgaagtttccgttgaaccaagctgatgagacatctacctgttgttctagttactgttagtgcataaaaaattacccaaaatttggtggccaaaaacaataatttattttgctcacgatattgtggattaagaatatagagagggcagttcttgctaaaagttttaaatgcaattgcagtcaagttgttagctggggctgcagttatatgaaggttcacctgggctggctgctcaccacagctttcccacatggctcgtagtggacgtctgctgccaactgggagctcagctggagctgtggacttgagggtgcacacatgtgtgacctctccatcacagcagtctcagggtagttgaacttcaggcatgactgctggctttttcagaaccaagaggaagtagaaagctttgtttgatcacaccttagaataattggttacaagtatatcattaagaccagcctgaattcaaggagagaggtataagcctcatctctcaatgggaagttgtcaaagagtttgtggacatgttttaaatctatcaccctgtgaaaagccaaaaatactgctccaatcaaaaaaaaattcttatattttggccaaagttccatttcctaaggattgtggggagggggaaggaaagtttttgtgaactcgggcaagtcattttaactcgctgattttcagttttctcttaccaaaatgaaagcaaaaatgcctactttattgtgctattgtttaatggggtgaggttggtggctcatgcctgtagttccaggtactcaggaggctgaggcaggaggactgcttgagcccagcagttggagactgcagtgagctgtgattacaccactgcactccagcctgggcaatagagtgagaccctgtctcaaaaaaatcattgcacttttgtaaatttaaatgaaaagacagtgtctaatatatagtagctcttattatttactcatattacatgaggtatccaaagagaatttctcgcaagatataatgaagaagatttgtatattggaagctttcatttatggttggagaaaaactgctaaagatttgtaattttgaatgaacattggcataaatagaaagccagcgcgcagagcagagaaggctgatatttttatgctaagctgtagaaatcaggaaatgtgtgataaggttatctgaaaaatagattcagagaaaccacagagagaggaaggggaaatcaaagtgaacattgatgaatgtgggtaaggatattgtgtgttggggaagcatcttagttcttccatttaatacacatgtgatgtttgaagcactcttatgaaaagtcatctttcatgttaagtggagatcatgtatttgtaacatttccatttggtagtcatatctctagctattaaaaatcacattgtgataaaatactcttttgataggtgctgactgtaaaatcatatggtagacattttctgcaatgtagcatgatttaatagaattgggaaaataatgtttttatatttctattataaataacattcatatagataatcttaccagttgctatcaatacagggaattcttgtttcaattaattagttaaaattttcattgtttttgtgctttactgtaatattgctactgttatttgaaacacattacatttgtataagcacatgtagcaatgccaaaaatattggggtgcctactctgtgcaggggtttacattagttgttgcatatttccaattcataattttgtgttttttgtattcctgtcattatggtatactttgttgtttttgcatagattttatagtctttttccaggttttaggtttggtaatagaaatacttctatctcatcaatttcaagtctactttcagaaatatttcaggaaggcaaactgcattcttaacaagagactatgttttcgttctttggaaatgggaagataattaagacccatattctgtcctcaggtagctaatagagtacactagtgtattagcctattagccatggcattttcaattgcaagaaatctaaggcaaaagggaattttagatcttacaattagaaataccgtagagttgttcacattatgaaaaataagttacaggattagggaagagcttatgttcaaatagttcaaagcagcaatggacgtattttgtattgaaaattccaaagatgatcataaagatgactccttggcacttgctcccaaatggattcatccttttattcattcagtctttcatccatccagtacttactgaactcccatatttgccaggcatttggtgctagagatagagaggtgaataagaccaagttttgcccttatgagagcaacagtctaatctagggagatgacagacagcaaaatcaatgaagagataatgaagggccacctagggatcattcctattaagctggtataagttggtttaaactagataatgaaagaaggtctttctgaagcggtgcctttgaacctgagatttgactgacatctctgcgaagatctgggaaagtcttcaggtggagggtagagcaggtgtaagaccctaggaaagtgggagcttggtagtatttcacaaacagtgaggaggtgggagtaaattcagcactttatgaagttttgtgcattcttcagtgttgttggcatcagtgagtgtgcgatagctagaaacaggtcaataaattattcatgatcaaaatgaatttgctgtttctctggccacattattgcacccttgggaagtggttagtttgccccacctggaccaaaggagagttccttacccaagaacctgaatcaatatgttttagtttagctatgtttttccacaagctcttaagctctttaattccataaagacaattatcactcctagacttaatcatttttctcttagcctctgtgttaccttctttaatcttattcaagacttgtttcctccagtcccttattgttttgccattaagccttatcaatatttgcttggagctatatttaatatattcacgttctttttctattctctctcattttttctgtgcaaggccaaatgtaaatgtcacgaaattatcagaatcttgaattttgatgtcacatttatgttttctatcataatgacttcttttaaagaataagggtatatatctcttatgaatgcttcttatttttaagttataatgtttctgccttttaaattagaggtggtaggatggtaatatgcctatgttaaatttgcttttctactagatgtgtttcctaactgctccaatctactcttgcctatactgtaatgttccatgctgtaaccagataattctttctgaaatacaaatttgaccacgccataattctgcctaaaatgtgttgatgatttcacattctttttgggtaaagatcagctccttacatggcctacaaagcctcaatgaaatagactcagcagcagggaggctcctctctgaccaaatcccttctcacttcaccagtttccattcactgaccttttcctccttagtttctgttctccatgccagtctgaaaacagagaatttgcatgtactcatttgtcgtgttcactacatttttttccctccttgactaactaacctatacatcctcccaaatctcaattcaatgatcacttcatgacagtcaccatctctggatagattgttaaaagcagatctagacagagtaccacatgcaatttctggtcaccctaaaacattatacatgcacacacagtgcatacacacatataccccacacacattccaggtaatattcagaaatcttactattttaataggaatgtgtttgcctaagttgaaccatgctcaaaaaaagaacattccaaattattaagctgactaaagctgtctttaaacagcagaatacatatacccactgttcagattagctaaatggggaaataactgcttttcaaggttattaacccacaatattctaatctcagatgctgtactagaacagtctggcacagttactgtttggtttatttttttactctagtgagctgtaggctgacacgttaccaatagcttcttttcattgtaagcagcatacagtgtgatgctcaaagtgtaaacaggataatttttaccattttcaggagcatctaagtcatctacagttggataacttttttccacaatttgtgaaatacaggtgtatctgtcaaaactgatgcacaattttctctgtttcttttatctgtataatgacttacccaattcctagtgtgcaagaaatattattgatgtcttattgaatcctgttgctttctgtatatactactgtgatcttggtggcatcttcatttattattctggtggacgcatgtagcttactatcagtgtttttatgagacaagaagcaatatctctcttttctaactaagcatttagacagtaaattctctttgcatggatagcagtgtggtcctactcaccactgcaacttcgttgcctagcatggcaccagcacacagttgaaacttcattcttgaaacagcctgtgggttagggatattctacctatttactagtgatgaaactgccccttaaaggaatgggtgagtgattgcccaagtgtacacagctgctaagtggtaggggtcaggctcttagtcgcagtgtggctcattatctagcatttgctaacatgttatggaggcattttgctactttaaaataatttatttattcaaacttcatattcactggtcagatttcccttgtcagactgagaaaagaaaccactcatttgcaggacagtagcaaacatcttacttgcattccagttgtgtatgggttcttttaaacttcataatattcttttcttattcctcttgctatatattgatggcaaccgtaggcctaggtttaccacatctctatagaacaaagccatatcttatgaattgttttaggtgctatctggactgacacagttttgttacctatagcaaaatatttactgctttgttgcagagaaagctagcagatggttttcatgacatcataggcagggaagagtagacatgtagggtccacatgtttggccttttttccaagagtctaacttcatatattcatgagaattttgaatgaagaattcaataaacttgttattgttctataatgagaaatctttatttgctgaaaacaaagcctattactgtgttctaaagaatagatctcagtctgaaaagaatgctagtgcaaagataaacttacataaaaaaactagtataaaatttaaatattattagcaatcatgattaaggatattattaattgtatatatatactatgtgccaaacaattggctaagtagtttatattttaccttatttaatccttaaaacccttttaacatatgaaaaaacttagaacttgaatgtttaagaaggtaatttttgttctaaaaactaataattagaagagttggggttaaagatatgttgaactctaaagtcgaaattattattgtttatattattcttttaaaaattaagataaatattatatattcattgtcatgattacttttataatatatttttccgacctgtctaaaatgctgtgaaggtaaagatcattatgtctgtttaattcaccactatattaaaagtattatattgcaccaccaatcatattgtatatgatttgtgtccattgtagatactcaataaaatatatcaaatgaatcaacttgagctttgaaggttgggattgtcacaacattaagagtgttataacctttcttctcagacatttttgaggagttggagataggaaactgcagagtttagcctgtttggaagaaagctggtgttttatagtttgcagcatgattggaatccagtgactcaactgcctttgaccatgaggtttcaataagaggcaagaagaacttcagttccaaggaaaatctcctgattaaaagagtcgtacactgatctcaaaaagacttcaatggcagcatggcatggagttcaagagtatgggctctggggctgggcacggtggctcacacctgtaatcccagcactttgggaggccgaggggggcggatcacgaggtcaggagattgagaccgtcctggctaacagggtgaaatcccttctctactaaaaatacaaaaaattagctgggcatgctggccggcacctgtagtcccagctactcaggaggctgaggcaggagaatagcgtgaacctggaagtcggaggttgcagagagccgagatcatgccactgcactccagcctgggtgaaagaggaagactccgtctcctaaaaaaaaaaaaaaaaaaaaaaaaaagagtatgggctccgggccagattatccgggttccattctaaagcactccacttattagctggtgacttttcaaatgacttctctatacccaaatgatctcatctgaaaattggagataatgattgtacctgcctcataggattattattattaagattaaatgaattactgataaaatacttagaacagtgcctgatacacaatatgtgttatgtagtgtttgttacatgagtattcattctaaaaagtcttttaaaatataaagtaaatgcttatagattttttttaaaaaattatgcatctgcttgaaaactaaaggatattatttgataaagtgctaagatgttctcagtgctagaattatataatagtagccacatcctggaaccataaaggcattcttaaggaagtttatatttaaaaaagcaaaataaagagccaggaatgagtaactagtgcacagactgtgaaaccagaggataatattctatatctgtaaatacacataacattaaaatccttaatttgacaactggcagaagaacacagcattgaatcttgtatattttcattttctctttctcttctctaccacattcatttccatgttacttttatccttttcagaatgaccaattgcttccgttttaaactatactcactgtacttgggatttatttctcttaccttatactggaaaaaaatgcaaaaaaagggcattcagaacttacgtgtcatttttatattgcgaattcaaggaaaataaatatttttgtgactttatttctaagtgttacatttgcttattttgtcttttccatatttccccctttccctgtctttggcatgacatttggaattgttattggaaagagaatcaactcagaaatcaggaaagttagccagtgacacattcctttattacatgatgcaaatattttgctttgctcttttaacatttttcttttccataacaagaagttttacagctacatttcacagattttacatctctgcatctaacagaaacataaaatgtagtttgcatttaggtatttgtattttattttactaggcaggaatgtggagtgtgtttgtgagcttgtgcatgtgagctggaaggaagtgtggttgcccagtacttcctcaactcatgactgaaactttgttccagttcaagaaggaaataaagagcccttcaaaatagaatactgaatactttcttcatccgctctatagaaatcaggccaggaagcaaattaaaattacaagaatatccaaaacagaattattttgcttgctgtctgtgtatttgaccactgccttttatgattttaacctttccagacattctctttggggtcggttttccttgtggcccataggagatcccactgaaatcatttactagttgttccagatttccccacaatccccattgcgctaagtggcggctaatgtgggagctgtcatgtttggaaaataccatgatgccatgagttaatttcatacctgtcacaagatcttgcatgcgatcccaggggaccagtggtatgtcacacactactgcaagcgttcgttagtacctctcaaagcaatgaaccatggccaagagatcttgttgcaacatatggcagcacctgtcaccaggcttcatgactggcataaaattaacctgttttcctgtttgatgcgctgcttttttttgcttatccgtaaaaaggatgagaataaattgtatttggaaacaatttactgttcctttcaagaagtataatggtagacttgggttactggacacaatgaatagacagtgtccttgtagaagtacacacactgctattcagtaaaggtggtattttatgaatttctgaatggcagtctgcacatctcacacaggaagcaacgttttagtttctgaactctgtcaaacttagacatagagcaagaaatgacattattgtgagccacattgtggaagaaaaatccaggaagcatgagtttcagatgtgagtttgcccttgcctttcgaatggtttcaagcaaccttgagcttcctctctcttctctctatatttctcacgctcagatcttagtattctaatggggacgcacgaaaaagggacccacagaaaaacaatattcagaatgatgccggatattcagtgtcttagaaaaatagattaatgggatttagtctttaagtcttaaaactgcaatttagcagttatttttatggataaagacaaagaatatagtccagcatttatatatggctttctacctcagagaaatagtaaaagttttttgatcaaatgatttctcaatagagaaagtatccggtttcttgcatcatttttcttttcttttcttttctattttggatcttcttatatatctttttgcagagccttaagcttcttaaaatatttattttaatcgaggggggagctgttttctatagctagtctttttccttcttcttaaggtaaatgcttcttagattctgtgagttttaaaattcatatacagcaaagaacaaagataaatttagcagtcttttccctttatgtcactaccaagtctagggaacaaatggtgctgttcttccacaatctggactggttgctttgaattctggagtaatcaatttttcctggcatttcttaaatggtcttttttattcactgaatctcctttgaaagtataaacattagtccttgttctatggttttggaaattgatgactgctattctcaaaggatagtatagttggaatgattgaaggagcagagcaaaaagctgaactgaaacaatggagggaggaaagatagtaccagagacaatgagagaagtgggcagtgattggaagggaatccgaagtagggattggggacttaaaggctgcttagacttgattaataaatgctgtataaatgaaatgctgagacaagggataaaattgcacttgagaagtcacttgaaaatgtgttaatgcctttacttgacaagcatttattttttcatcctgggtataaaaccactgtaggaaaatgtagatcattttttcacactgagtattttttaactgctgattatggttatgttgtcctaaaatcaggtttctattatctgaaaagaaaataaaaagaaataaatataggtgtgtaaagataagtattttggaggcatggatcttcaggtgaagtgtcatgtaatatctttgctaagtcgggataaaaataaaatttaaaactgaaattcatatttaaaaagttcttagtagagtctaggcatttttttttttttagtgtacctaacagtgatgaaaattttgtatctaaaagaatgagggattttgcaagggattttcaggagactgtggcactgtcatggatggtagctataccattttctaacaaagtatgtcaagaaaattgaacatcagtcttcttactagaaaagagaatctgtggcaaattattttattaataacagcaaactgaagagccacaaaataatttagataagaattaaagtgctgaataacttagataagaattaaagtgctgaataatttagataagaattaaagtgctgaaacaattttattactggtaaagctgaattcagaactgcttctggtaattttactgtatcaagcaggccctgagaaagacaacctggaactgtttaaagggagatgttcaacgatggtcacaagatgcaggactcaagagcttccaccattagaaactatcacctttactaccaccaacaaaatacctttttctctgagaaggagtcagtgaagggtagagatgaaataggaaaaatttggttggttgggtgggtagtaagtttaatcattactcttctttaatgagtaatagagtggaaataactttcctctctggttttaaaagttaactaatagtaagtgtctttgttaaaacacgtagacacacacatgcaccacacacacacacacatgcaccacacacacacacacacacacgcacacacaacaactgtttgctacaggatttctaattaatgatatcacattttctaacccagtaattcccaactggggttatttttttcccctaggggacatctgacaatgtctagatacattttttggtagtaatgacttgtattactggtttctcaagggtagagaccagtgattctcctaaattctcctacaacacccagcatatctcctcacaacaaggaattattcagttggaaatttcaagggccctcaggttgataagccctgtaattgcttgaagtaacttaatctccctagtaattgtgcagtatctcatagttattccttcttccactactactccccacaaatttgcccacaaacttgagaatttacataactccaggagtacaatagaaagggacctcacatccaagtgcttgggtactgtgctatcctctggttccttatttgccttcaccactatgatttactattggtaaagttgtggtcatgtcggttctcctggactaccagagcccagaaatcttctcttgttgatggttcacctctgtcttaaagtctactttgtctaatgttaatataactaccccagatttgttttatttttccaatttgtaccttttttttttttttttttgagacaaagtcccactctgtcgcccaggctggaatgcagtggcacaatctcagcttactgcaacctctgtctcctgggttcaagcgattctcatgcctcagccccccaaatagctgggattacaggcacatgccaccatgactggctaatttttgtatttttagtagagatggggtttcaccatgttggccaggctggtcatgaactcctggcctcaagtgatctgcttgccttggcctcccaaagtgctgggattacaggcgtgagccaccatgcccagcctatttctttttcctatatttttgcttttgctttgtaaatacctttgaatatacagtttatctcttctagatacgacataatcatatcatttcaaaaactattctgctaatccttactttttgttagtgtttaattcatttatgtcttatataattactgataaggtagaattgatgcctggtgtttctatgtctttgcttttttattccttcatatctgccttgtttttcattaaataaatattgtctggcatgccattttattaccttgtttcttttgttgtagctttaaaactattttcttagtatctgttctggggaatacaattagcattttactaaaataatctagatcagataaaaattaacttaatagtatacagaaactttgctctaatatgtacctgttacttctttcctccttggctgttattgtcatacaaattacttttatactgtgtaagcccattaacgtggtattataattcttgatttatgtagttgtcttttaatcggatagaagaaaagagttacaacaatattttaatactttcttttgtattttcctttactagtgttctttatttatttgtatagattgaggttaacatctagtgttctttcattttagcttgaaggatccttaacatttttggcagtgcaggactgctagtaagaaattatctcagtttctgtttatccaagaatgtcttattattatttttgtaattttcaaagaatagttttgctgtgtatagaattcttggttgactgtttgtgactggttgactgtctttctccttcagcacattgaatatgtcatcccactgaaaaatgtgaatggcttcacaaatttgcatgtcatctttgcccaaggaccatagtaaccttccctgtatcattcaagttttagatgggtcaccaaagcaagcactctggatctttccatactgcaatagaaatgaggaagacttgggggaacttactatttctctccatataaatcctgcctttgccactttttatctgttttctggactatactgtatagaatacagggtctttctaagaaaacaaaatactttgattttgtgtccagggatccaagtaaaagccctgcttttggggcatctggtggttttctaacagctcctgctctgattgtttccttgtattccagttttctgcctaatcacatgcagaaccattccattcacatagtgaatacatctctcacttgacacagggatcctcatttatgggaaagaaacacaaacctttcatttgaaaaagatattattatgtttgctttatgcagtacataaataaaacttgatgatcactttctcatagccattctcttcacgaatatcattagcattcaatgcagaaattagcctgcagtcttcccctaatgtttgcatgtatcttttttgtgatccaacattttgctattaaatagaatgaattatgtggagacatgattagataataccaagagtataagtttcctgagattagcaatcacacatggtttattttagtcctttgtagaatgttgtgactatctttctatttatgtacacatgtatctatgaagtacttattcatccatccttttattcattagtctagccagtcaactatctattcatctatctgtctgtctatctgtctctaacatatctttttcttcacaggaattcaatttgatgttagcatatgatagttgtctaataaatacatgttaaattaaattcatatgaggaatacagactctagtgtaaactattggcattactgaaatatgggcttgatcattcattgtgtgggtaactaccccatgggtacatacattggatgtttagaaccatcatccccggcatctcaatataagccagtattattctcccaattgtaacaaccaaaaatgtcttcagataacataaaaacatccgtgggggaaaaatccctctcctccaccccagttgagaacagctggtataaaagcatcctttccttcttttatcacagtatgtatgattaaaataaatgttaacaatgactaatagtagggaatttatcagatgaatgaatgcatttacatatgtattttccagatagtcacactctccctcactgattcatccacccatttattattcaacaaacacttactatgtaccaattatccactaagtactttgccaggtagaggggatacattcgtgaaatgtaagtttctgccctgatggggcttacagactttcggtggaactagataaaacaacgaaacaaaagatattactaataagtgttttgtttacaataaggcaggaagttataagggaaagacaggggggctgcatgagattagtggacaaggaaggactttctgaggtgacatttaaggtgagaaatgaataataagaggaaaacaaacaaagatgtgaaaaatttattcattaattttacttatttcttatagcatatgaggtttatgctaggagtgcaaaaggatgatcatttggtggcatatcaacttgcttctctacccatatttgtgaaaaacaccagattgtttgtgtggaagccactgggaactgttccaaaccgtgtgagaagtctgacgttttttattgagggagcatagccctaccaatgtaaaggcgttgttttatgacaatgccgtgaaaactggtaagacattgaaaagcaaaaatgagacatgcagaccttaaaatatcctgtgtgataagaactagtgattgttcactgaaaaagacaaattttagttctatcttcatgacattatatgttgctggggagatggtggtgaccagggaaaactgttcagaggaaaatcctggcctgatacatttaaaagaaagcaggtaaatgcgtattcatctttttttttttttctccaacctcagtagatctaaggacattaatcagaccttgggataattatatatagctgtgctatgagtacgtggattcatttataattccattggtagtagataatgcaattaagtacaaaattctgcagaatctattatatcgttgtttgacgaatcaaataatgtattctgcatttttattctcatgaatatttcccttataaatagatgtctaaaatgaactattttgcatatgcttgccttatgaaagtaggcttatccactggaaatacaaagctgttttaagcatatttgtgtgtttaaacatgcttacgcatgttttcaagcataattgaaataattagaataagtttcattatcacctttcaccttttatgctagatgctggatcaagtcaaaactggaattgcaagtcaaacatcttgatgagatacagaattctgtaaagggaagagatgaattacaaaatacaaccttgtttgaggaagacattatgacagctgggtgacttgggcatttaaatggaatctgatgaagtccctcccaccattttctctataaaatgccaatggcatttaaaagtagtgtcaccagaggagccaatgtatatttttatactgcaattaagcaattgagtacaaaattcagtacagtcagtgggaatgtgatcagatgaataaaggaagtcagagaagataatcatttcagttctttccctaattttgctttctagcctggtacttaaaattcacaggctcacaagtctcactgggctccagagaagaagcctgactcctccccagctgtgtactctcaggcaaactacgtagactctacctcagtttactcaattttaaaattgagatcataattcttgtcttctagaatatttgtgaggattgaatgaaatactatgtataatatgcacattacatagctaatgctcaataaatcataactttatgattagcaatgtttgtttccctcagaagtgacctaaaaccaacaacaacaatatttttattttgctttctatgatcactgctaattatgaaaaaaaaaatgtgcctgccttgatgcttaggaaagaaaaatggttgcaatgagagagaaagcagtgtttccagacttgtgatgactttattcagttttctgcattttgtttctctctggcagttttttttctcctgtcactttcaagattgaacataattacagtaatgaattataaatgaacataatatgtaatgaatataatacataaagtttattacccccattttcataattctgattccaagttagagatccccttccaagataggctccatagcctcctgtgtaagatgtctctgcccaccctaccccagataacaccacccagtttgtctcctgcaaggcacttatcacaacccttaatgttttttgttattcgcagggggtcctgatccatgccccaaaagtgggttcttggatctcgcacaagaaagaatttggggcaagtccatagagtaaagtgaaagcaagtttattaagaaagtagggctgggcatggtggctcatgcctgtaatcccagcactttgggaggccgaagtgagtggatcacctgaggtcaggagatcaagaccagcctggccaacatggtgaaaccccatctctactaaaaatacaaaaattagccaggcatggtgacgcacccctgtaatcccagctacttgggaggctgaggcaggagaaccacttgaacttagtaggcgtaggttgcagtgagccgagattgcgccattgcactccagcctgggtgacagagtgagactttgtctcaaaaaaaaaaaaaaaaaattaaacaaagaaagtaaaggaataaaagaatggctactctatagacagaacagaagcatgagctacccagttgcttatacttattgttacttattgattaatgctaaacaaggggtggattattcatgattttccaggaaagcggtaggcaattcccagaactgagggttctttccctttttagaccatataaggtaactttctgacgttgccatggcatttgtaaactgtcatggcactggtgggagtgtcttttagcgtgctaattagaatataatgagcagtgaggaccaccagaggtcactttcattaccattttggttttggtgggatttggccagcttcttcaccgccacctgttttatcagcaaggtctttatgacctgtatcttgtgccaacctcctatctcatcctctgacttagaatacccatccttctgggaatgcagcccagtaggtctcagccttattttacctaacccccattcaagatggagttgctctggttcaaacgcctctgacattttcatttatacttttcacatatgtatcaacatataatataaaaatttaaaatgtcatatattatatattaatacatattatatttaccatcattagaatgtaaattctagtaggtcagtgaagaaatctgtcttgttcaccactccctctctagacaatagctctgtgccaggtacatgcagacactcaatgtatattgaatgttgaagaacttttcctgcaaaccgtaattgccacctgataggtttacacattcgattgtcttttcacctgctcttatataaatttgtgctgagacacgcaagccatttgatgttgtagttattttttacagtagaggtgctttgggaaagatgattgagatacctccttataatcttagaatccatcctaaaatgtcttctactcagataataaatgccagtctttgatttgatatatttaactctttaggtaatatttacaatacatagaactaactggatttagtaagatgctttaatttactgatagcatgctacttattagtgtgtgccttcaagcatcaaatataccaaaaaaatgatcatttttgttatggtagcagatagatacattgctccactggtgtctttttttgtttttttttttgagatggagtctcactctatcatccagggtggagtgcagtggcacgatctcagttcactgcaacctccgcctcccgggttgaagcgattctcctgcctcagcctcccgagtagctgggactacaggcgtgcgccatcacgccaggctaagttttttgtatttttagtagagatggggttttaccctgttggccaggctggtctcaaactcctgacctcgggcaatctgcccaccttagcctcccaaagtgctgggattacaggcatgagccactatgacccgccttcactggaattctttagctagccttattttacttggattctgattgaaatatgttctcctcagaatacaggatgaaacaaagctaatttaaggtgaccaagtttatacattaagtacaattagtgcatttttcaccagaaagttggtcactactttaagattttaccttcattttcattagaaggtattggttaatctattatctcctctctctaactgcagtcatcatattaaacttttgcaaattttaggtgacaaacacatgtcgaatttacatatatacaggcataatttacatatatgcatatacaatgtacaatatatccagaaggtaattagcaactggttacagtttgctactaatgtacaatatatccagaaggtaattagcaactggttacagtttgctactaatgaggtcaagtttacagatctactgttcctctgagtctgtcttttggctctgttgcattgccacagatcctatcatgatccctgggctgctgtttcacacacgttgtttgtcacaggaggggggccatgaaggaggatgtgattgctcccctgccaaccccctacctctactggtcaaggatctcagcatttttctgacgaatggcatgggcgggatgcgctccatctttgcattctctatgtgtcaggctgtgtccacagggaattgtctgtgaagggtttttaaatcagtgggaccagtaacaccatctttatatagtgaagacagcttatcattaaatatagtttgagacaagcttaattgtgcaactgaaaaatattttcgataatatttacaacttttatctatttagtgttattagatgaagactttatcatttttttccatcatgcctttggttttgtgagcttcttttttgtttttatttcccgatttctttctttcagatacttttaatcaacatttcttcctttggaaaacaggtcaaatgacaatgcgaagggtgatcaaggagaaaatgtgtgaagtagaagcctagaactcaagagaaatgaataatatcttggcatcacttactttgctttaatttcttagttttactcctttaatgtaacaactgtttttcatttaaaagggagtcatgaaacaaacatctatataatattttggggattaaaaatgcatttgcaaagttagatttattggtttttatcttaaagacataaaaacttgatatcatatttaattttgtgctcaaacttaccgataacacattacttaatccttgaaattatttgctttattccctgttgtggattaagatgagtgattttattctgaaaatattaggttgttgtaaaagtaattgtggtttttgccattaataattcacaatatgagagcaattatagaatctagctaaaattatatgtatttatccatctctcattattcatggtagttatcttctataaagtctctgcaaacactgaattagtaaatactgaacaattactcctggtaggtaaataagagcttggttcctgcacgactctggccacatttttgtcaatctatcaatacataatcttattttatatgtatttctgtttaatgatatcttatgtaatacatattgtatgctcattaatacatttatttaatacatattgatttaatacatatcttatttaatacatattttatgctcattaatacatttatttaatacatattgatttaatacatcttatttaatacatattgtatgctcattaatacatttacttaatacatattgatgctcatgtgctttcgagcatcaaatataccaaaaaaatgatcatttttgttatggtagcacatagatacattgctccactggtatctttttttttttttttttttttgagatggagtctcactctatcacccagggtggagtgcagtatactcacagtatactcatagccaatagcaccgtaactcacccctcattgaagcttgttcaacacagtttttttctctgtaaggcatgttatagcctccttgtgcttaagaaaactagggagcacttctgcattatttttaaacagcaagtcattttaaacagcagaatcataaacaaaaaacataaaaatgagaagaactaaatagaccatgaaaaaaccacttgtttatagtaagagaactgaaacatgaaggcagagtttcactttgttcaacctcagctggcaacatgtgtagggggtaactcaaattttgtgattctctgcacatgttggggaaagatcacacaaatattgtgagtattaatttggagtacaaattaatattagcaaatagctgtatttgcaaatatggaatctgtggataatgagaacagacagtatttatattctaggttagaaaagagaaaatgagctccttttagtcatcagaagccaatgaaagacctgggtttagtattttcttccatctcttgatttctgtttgcttaattgaatgacaaattctaattagtcatgcctgactaacataatttaggatgaaactatgtcttcatcactctctacttctgaccctggccctgttcctagagtacagtaggcattcagttaatgcttgttgaaagaatgcataaacccctttcctcatttggaactttatggaattgctgagaacatcagatggcaataaggtgattggagctgtaatcacacacaaaaagttgtctattttaattagccaggtgtggtggcacacacctgtaatcccagctacttgggaggctgaggcaggagaattgcttgaacccgggagacagaggttgtggtgagcagagaatgtaccactgcactccagcttgggcaatagaatgagactctgtctcaaaaaaaaaaaaaagaaagaaagaaaaagaaaaaaagttaaaaccaccaaattgtttattttctattttgaggattttaattttgcttaataacatagtcattgaaattaatttataaataatattgtatagttcaaaacattaatataggacttttttgctgtaaaccagggttgcctgtttaatatttgtatttcattatgagtagtgaactagtatctcttgtaatgcaaggtaaagaggaagaggttggttaacaaaaaggaactatgttaattttgctattaataagggggaaaaccttttgaatttatttatcctggagacacaaaacttaaactcataatgatgtcatatatattagcattactatatttccttattattgcaaatgtattctacccaggtcttttcatcattgtagtcacttaaaaaacatattgggtaagttttattatacaatttttctcagattgattttagttttattttttcttttctcttcttttcttttctttttctttttcttttttttaacctcagaaggaattagatgtccagtataaagaagcctgatcactctggccttacttggctttccaataatagtatttttaggatcactgatataaaacctacaaagtaagtaatttggttcatataagcaggcaagtaataaattttcctatacattgttatttctcattaaatacatactattactctccaaataagagatttttagaggtcattttttttctcatttttttaaaatactgactgacccatatttgcactggtagactcagaagtgtttggtttatacttgttcaaaatgattgtcagcagatgtaatgagccttggaccagtccagtaacttggctaacatatgtctgcagaaggattttaaaatcctgctgactaggctggtcctgtcgagtctcacagcagaaaaattgtcttttgcagctcagcttataaatataacctttgtgtgtttggaaatatcccttctaaggcaggacttatgctcaccctgaaattcaaatgttcattttgatgtcagcactaaccaggagaaagaaaaggtggaaacgattcctcttgcacgtttcagagtgttagaaaccgcctattatttgtgtcttgttctttgctgctctgtacaagctctagaagtcataaaagtgttcctcacaaattgactccttagaaatgctgactctgtgtttcaaatcttataaaaatatctaaatggtagacgtattgttttcattacagatgcattaagtcaaaactgccaaaggctgtgttgtttctgcaaacagggcaactactgcttgaatggggctaatctgtttaggcactgaggggctagctgtgctgtctgcacatatttaatcacaaagctttacttgactttcccacatatttccttttagtatttttacttatggaaagcaagaatcaggttttatagtcattcagtaagtcctctttttaaataaaaattgttatattggaaacagtgtctacaagaccactggtggaaattaatatagccaatataattagtaagttggattcaccacaccacagtaggtaaatcttattgggggcaaaaattgctatcttattcacaagtgtgttgagctgttcttgtattgctataaaggaatacccgagacttagtaatttataaagaaaagaggttagttggctcatggttctgcagtctacaaccatggcaccgctcagcttctggggaagccacagggagcttttactcatggtggaaggtgaagcggaagcaggcacgtcacatggccagagcaggagcaagagggagagagtgggggaggcgccacacgcttctaaacaaccagatctcaagagaactcactatcatggacagcacccagccatgagggatctacccgcatcacccagatacctcctaccaggcaccacctccaaaatcagggagtacgtttcaacaggagatgtggttgagacagatatccaagctgtatcaccaagtgaactaccgaagctttttattgatttgtattaagccaacacatgggtttacccagtaactcatgatttttacacaaaaaccaaattaatgtttatcgaacagttatttggatataaatacatagatatagcacagtgcttcaggttagtttataaaaatcaagtctttcctttaaataataaatgatttatgcattcattcaaatttagaatgctgaggaataaactacaaaaaaaacttgtggctgagtgcagcggctcatgcttgtaatcctagcactttgggaggccgaggtggatggttctcttgaggccaggagtttgagaccagccttgccaacatggggaaaacttgtctctactaaaaatacaaaaaattagccgggcatgatggcaggtgcctgtagtcccagctactctggaggctgtagcacaagaatcgcttcaaccggggaggtgaaggttgcagtgggctgagagatcgagccactgcactccagcctgggccacagagtgacactccatcaaaaaaaattttaaaaaaaccctaattgaatctttccccctgtatttctgagaaaaaggagcaaatataaaataaacaaaaagaatacatatggaacatttatttagaaatcaaagacccagcgtcatacgttctaatgtttgataagatactacccagtttcctgcaactttcacttttgttctgtcaaagattccaaatgatgattgtgagccactgtaacctgaagacatattggatacatttacttatgtgtgttaaattgtgattcttaatgctattttgtggaaaggctggagaagattttttttttttttttgagatggagtcttgctctgtcactcagcctctggggttcaagcaattctcctgcctcagcctcctgagtagctgggattacaggcagttgccaccacacccagctaatttttgaatttttttgtagagacaggcttcactgtgttggccaggttaatctcaaactcctgacttcaggtgacccatccaccttagatttttaaaataaaggttacaggctgggagcagtggctcacacctgtgttctaagcactttgggaggccgaggcaggcagatcggttgagcctaggagttcaagaccagactgggcaacatgacgaaaccctgtctctatacaaaattcaaaaattagctgggtgtggtggcaggcacctgcagtctcggctactcaggagggtgaggttggagaatcacttgagcctgggaggtcgaggatgcagtgagtcatgattacaccactgctctccagtctgggtgacagagcaagactcttgtctcaaaataaataggtacgtacatacctacatacgtactagaatcaagggggttgtttctgagttcattgagttaacgaggaaggtaaattaatcaggaccttcccaagttacccatgtaatattatttaattgtacatgtttaaacaagctcagattacgttgactgtgagtcttaaaacggtaaccacaaacaggttataccaagatccctcacaatgtgtgttgtctgagagaaaaatcttatcattttctttttttccacattcactattgttcctagattatgaaaggtagtcattcactaaacccttctaaaatattccttttttttccaaatatagaattattatattagtaacagtacaggcatgcccataacaaaaaatggaaactaatatagtcaatataattagtaagtttgattcatcacatcccagggtagaatacctcttgaccttcaaaactgcggtcgaccacaattcagattttgagctattcaccagtgagaatgcatggcaatacatgcctaattggcatagttacatgtcattaatttattccttttattcatttaacaaatatttattgaatgtttactatgtgccagacactataatgctgttctaagatagcttatattacttattattgaaattatacttattaaaatggtaataatttgtagagagattaaactttgttttcttgccctccctttctccttctcctcttcctttcttcctttgtttcttttctttctttgcctccttcttttgtgtagccataaacaggagtctactgggtcgtttctgtttgtaaggcacaatctgcctcccaatccccctcccaaaaaaactaacaaaatttagggaaggagctgatttcacatttcttcagagggcctgttagagtgataaaaggcaaaattattttctttacacgaacagtcacagaaccaaaaaggccaaggaagaagccagagagcacatagtatttaattaggagagtttctagtgtcccgaagccacagaagaagcagctgcttaaacattgcttaccctttgactaatggccaaaagcactgaataggagaaggattaacatggataagacttaaataaaagtgatacaatcatcagagcaacaacaaacaaaggcacattaaaaagtaacatgaaatgatgttaagaaagaggtcatggatgcaaaatgataaaatgtttcgttctttggaagtaactctttttttttcttctgttcttagtcatccatctctgtcagagttctcaaataaaaatgcaaaggaaagttagcaccactctaaaacagtgaagggtcagttctctgcttttggatatgtaatttgaatgggaagtgtcctaatgacaattaaacacaattttctaagcacaggaagaggactgataaagtcaagcaatggctgtggcttttcttttgtacttccgttactattaactatatgcaagttaacaaatgctggacagcctgtccagtgagcagggttgctccgttgccaggcttatgttttaagcgacgattgagtgtacacagatctaaacaatcatgtgcaaagtctaagtctctcattttgaattcggaagagagaaccttggtgccccttcttcctgaggaaatttgggaactatagtacaactccctctcaaaaaaaaaatactcctgtaattccatcctaactactgattgctttatatttttgatgtggtgaggagttcagaccccttcttagtgaatgcaatgtttagcacattctttggaatatactgcttgagtctcttggtgcatcagctgaaacttcattttaatatcccgtacgcacttagtagatacttgcctttcctctacattggtgattattcctggcctatcattcagttaagacctatcctccatatacagatttttatatcgttcatcgaaattaagacttgttgcaagtaataaaaactgaactcaagctacctaatacaaatggaatttactattttatataccaaaattctgtgaaaatacaggtgggactggccttagggatacctgatattaggatataaatcctgtcgcctttctctcatgcttttttttcttccctttgtaatcacttctttattatttgtcactgacctcttcatgaatttagaaccacggtcgtcggcactttctaactcatgctttcatagtttcatgaccacagaggaaaagaggctttggaaattctcaaggaatcactgtgactatccacacttgggtcacattttggactcattgcagcagcctgaaggttagatggtatggatgccccagcttaggtcatgagcctgcacttgggaaaaatgaggggaagttatttttaaaatggaaagaagtggaaggcagacattgtatccagttttatatatttatataaacaaaacactgtaagggggaaaatatagacttgaatcagaggagaagagttaaaccaatgtttatatatttctttaggtttgttggaatatatgtgcatgtaattatatcagcaaactacatagtgaagtcagggagacagattagagagataggaagagtgggagggagagaatgtgcaaaacaagcaacagaaagaagagtggggacatcctgagtttgtatgtgaggagaggacagataggagaggtacaaaggaaagggattagaacagagaattagttagaggatggggagataatacaagggagagatagccaggcatggtggtgcgcacctgtagtcccagctgctcgggaggcagaggtgggaggattgcttgagtcggggagatggaggcttcagagagctgtgatcacactactacacttcaacctgtgtgacaaagtgagacctcgtcttaagaaaataaataaaataaaataaatataagggataagtagagagatcatgagagaaaggaacatagagggacacagatgcaagaacagggaaagagaaggggtcagaaaagcgtaatttgtggagagaaaattaaaatgctattattattggtattattgctgcagttgctctcttttgcccattagactattttggcattattggcaggtttaatgtaaaatgagatttgtgagtaacattgatctccaaattataaatgtctttcaataggatatgaacaaatatcatagtaattctcaaagaatattgctatttttaatcaatggagtatacaacatattatattttaaaatcatacaatacttcaaacaccgtgaagagagaacaaagccatatcaaataatgaatgaatggttgtattacggaagtacttgtcctgatagaacacttcaaataccatttggctgctacttctctctgggtttgctttgtatcccatggagatgatctgagcttaagcttttgttagcttcaaagagagctccgttcttgcctcatctctgcagtattgaaaaaacagacccttggttaacaacaggaagccaaactgattttaatattgtgaactctttaccctgatgcaggaaatgttatctgggccatctcagtgggctggggattatagagctggataaggcttcaaaatacaaatgaactccataggtctggtacagctgtaaggtacaggggtagagaatattaggtggtcatcttgataatcatttgtgttatgttaatgcactccaaagtggacttgtttcttctacctgagtgtatatacaaccagtcttttcactattttcagtggttataactcaggaaagagacaacatatcaacatatgaatgtgggtatatccaacgagatctctcttataattttagtccataaataggcataaaaaatgtgttctttcagaaaacacttactggaacctgagataatacaataagtcgaattgctaaaaagagaccccatggatcacaggtctgacctaatatctagttttactaataattttaatggtataggtaatcacatggcatgggtgagccagggagagaggtctttgaccttcagtatagctcgcaaatgctttctttccacataagagcatgcactggacccacaggaaatctctaggtgacatgtgcagtttacattccttgctcaataggagtatttaggtaattaaaatctccatttatattcagatacttgcatagctttttccaggagaccatgcccataaatgcatagatttcaggtttgtttatcataagcagtgctagatagtgagcatttgatagatagggactgtctctaaatgccattaacttgcttgccaggagggtctctcattcatgagtcaaatctcatgtttaataggagatttgactgggctaccttgtttatttccagggagtggtcccttggtgaaaagagagaatgagtggtagacctattatttgaccatattcctcctaaataccttcttggtgatatggatacagagattagcaaaacagtcactgccttcaaatttttttaccatataagatgatgaacacaaaatcaacaccagagataatgtgcctaaacccttaaataacttgtgtgacacagaacaagtatctcaatagacagtaatattttttacgatagtattaacaatgccgtgttaaggtgctataacctggttgaatcttatttggatggtggagtcttagtggacaatggaatttgtacaagttttgagtatacttattctgctgacatttattgagtaacctcccatgtgccagacattatctgacgtgaaatgaaagagaattcctggtttccgtgagtttttagtcttagagaagacacagtcacgtaaataaataattgaaaaatatcataaagtgtttataaaaatctacttgttaagtatgagagtgcagcatacttggcctccagaaatgcagaaagtttcatcaatatacaaattaaatcttgaaggatgagtgaacacttactgggtaaataacaagatgaaagactttaggggaagagaatgagatgggctaagttagcagcatcagtgaacatatggacatgggggtgctgcagattcttaccattggttcccttttggatgttgatctaggaaaatgctggaaaattaggtttgcctcagatgatatattaggccaacaggaatgaatgataataaaaatagctaccaattttgagaaattactatgttccaggtacaatattaggtacacatttttaatattcatgacagattaggaggatgtaacatcttgattttataaataagaatttagttcagcagctagttagatactatgttgggatgtgcctccataactctcttactgcaaacccatccctctccatgaccctgtgtgagctcccctaggcttcgaagcttgcacattgttctcacctgacaggggagcagtgaaacaacactaggaggacaattagtcatcattcagagtgtatatcagtgtgcctctgcgaacacccacaggaaaaaataaatctacgaatagtgagattgctttggaaatacaatatcaaaacaaggtcactgctaccttctctctccattccatcgagattgcagctcctggcacctcttcaacaggaagttgttggccgcctctcccttgaaggttttagtaggagaatgaaaggatcagtattgggtttcagaaagataaattgcttaccaattgatggaaaatggcagcttagagaatctgtggttagagaaaattgtttgaaacttactataatatttcagagatgaagtaataagaagaatctggagtggcaaacatagatcaattgattgaaactaaaactaataagacttgctgtgaccattgaggggacccaagatatcagtttgaatcactacagtgagcagtgaggctacttagatagaaattgccagaaaaagaaaataaatgaacctttggatttactgagtttgtgggggctgaatgctaaagttttttgtttgagttgggggtagcttataggcaggcaggaactggctctgatgcaaacagaggtgatgggatagaagacatggatttgggttctgatgactttgtgagagtgaatgggaaagcacattcaatggcaagaaccttacaaggaggtagggcacaatgtggttaagctataatttttactatatttcttcatttttattggcatccaattattttatatgtactcactatttatttaaacagctttattcatggggtgcctattctgtgcaaggcaatacctttggcaatgacgacatgatgatgagcaaagcctgaatgtttcttactctcctgagtttattgtctagtaagagacaagcatcataagacattacactagtgaatgtataatttgaaactgagataagtgctctcgtgtgaaacatcttatttctaggaaaaaaaaaagtgcaacaaaaaaaagagaaaacccttgtgatatgaaaggtttccgaagaaagtgcagctgtgttaagacctgaaggataagagttgccatctaggcaaaaggtgatgaaagtaaaggattctccagactgatggaaaagttataacaagagattggagtgtttaggaagttaaaagaacatgtaattgaagctcaggagggggaagagagatgagagatgtgtgtagagtccagagcactcagaatttgcagaataataaggattttgatccatgttctgagtaatgacatgccattgaaggtttccattttttaaaaatattaacccagatctcctttacatgagcaatacagataggaagtgctgaggaatcaaagtagaggtagaagggattcagaccccagagtgtctacattaggagggagctgaacctcatcaagttctttccataggattttcttcatgcacaaatatgcatggctggcttagtctgcagaccacatttttggttcacctagtgtttcagatggcagatgacataactctgagtaaattagaagttctggctgtaccaaaaatatatacatcaggaaaatgaaaaaggaaactgttctgtgctgcttaagagaattcattgccaacctcctactggctgttctgacccaataaacaagcaaaagtgacttgttagagccagcagctatattttgagtaccattatccccactgaataattcaacacttaatggtggtgattttggttgctcagagaaggtattcttttgcaattgtgtagctctttgttgagattcagcattgtctagttaacagtatgagaagcaaagcagaattcttgctgtgaaaatcactacttctaaagagatgcggcattgccatatagtagttacattgtgcaattactacatggaaattacttgctgtcttgtagtctttttccggaaagaagacactcttttttattattattatactttaagttctgggttacatgtacagaacatgcagttttgatatataggaatacacatgccgtggtggtttgctgcacccatcaacccatcacctacattagctatttctcctaatggtatccctccccagcaccgcaccgccaacaggccctggtgtgtgatgttcccctccctttatccatgtgttctccttgttcaactcccacttatgcgtgagaatatgtggtgcatggttttctgatcttgtgatagcttgctgagaatgatggtttccagctttatccatgtccctgcaaaggacaagaactcatcctttttatggttgcatagtattccatggtgtatatgtgccacattttcttaatccagtctatcactgatggacatttgggttggttccaagtctttgctattgtgaattgtgccacaataaacatacatgtgcatgtgtctatcgtagaatgatttataattctttgggtatatgcccagtaatgggattgctgggtcaaatggtatttctagttctgcatccttaaggaattgccacactgtcttccacaatggttgaactaatttacactcccaccaacagtgtaaaagcattcctatttttccacaaactctccagcatctgttgtttcctgactttttaaagatggcaattctaactggcatgagatggcatctcattgtggttttgatttgcatttctctaatgaccagtgatgatgagcattttttcatatgtctgttggctgcataaatgtcttcttttgagaaatgtctgttcatatcctttgcccatttgttgatcaggttgtttctttttttcttgtaaatttgtttaagttctttgtagattctggataggtcttcgtcagatggataaattgcaaaaattttctcccaatctgtaggttgcctgttcactctgatgatagtttcttttgctgtgaagaagctctttagtttaattagatcccatttgtcagtgttggcttttgttgccattgcttttagtgttttagacatgaattctttgcccatacctatgttctgaatggtattgcccaggttttcttctagagtttttatggtctaggtcttacgtttaagtctttgacctatcttgagttgatttttgtgtaaggtgtaaggaaggggtccagtttcagttttctgcatatggctaccagttttaccaacaccatttattaaatagggaatctttttcccattgctagtgtgtgtcaggtttgtcaaaaatcagttggttgtagctgcgtggtgttatttctgaggcctccattctgttccactggtctatatatctgttttggtaccagtaccatgctgttttggttactgtagacttgtagtgtagtttgaagttaggtagcgtgatgcctctagctttgttcttcttgcccaggattgttttggatatgcaggctcttttttggttccatatgaagtttaaagtaatttttttccaattctgtgaagaaagtcactggtagcttgatggggatagcattgaatctatacattattttgagcagtatggccattttcacaatattgattcttcctatccatgagcatggaatgcttttctatttgtgtcttctcttgtttccttgagcagtggtttgtagttcttgaagaggcccttcacatcccttgtaagttgtattcctaggcattttattatctcagtagcaattgtgaatgggagttcactcatgatttggctctctgtttgttattggtggataggaatgcttgtgatttttgcacgttgattttgtatcctgaggctttgctgaagttgcttatcagcttaaggagattttgggctgagaagatggggttttctaattatacaatcatgtcaactccaaacagagacaatttgacttcctatttgaatacactttatttctttctcttgcctgattgccctggccggaacttccaatactatgttgaataggagtggtgagagagggcatccttgtcttgtgctggttttcaaagggaatgcttccagtttttgcccattcagtatgatattggttgtgggtttgccataaatagctcttattattttgagatgtgttccattgatacctagtttattgagagattttagcatgaaggggtgttatattttatcaaaggccttttctgtatctattgagataatcatgtggcttttgtcattggttctgtttgtgtgatggattgcatgtattgatttgcatatgttgaaccagccttgcatcccaggtacgaagccaacttcgtacctggtggtaagctttttgatgtgctgctttttgatgtgctgctggattccatttgctagtattttattgaggattttcacatcaatgttcatcagggatattggcctgaatttttgttgttgttgttgtgtttctgccaggttttggtatcaggatgatgctggcctcataaaatgagttagggaggattccctcttttcctgttgtttggaatagtttcagaaggaatggtaccagctcttctttgtacctctggtagaatacggctgtgaatccatctggtcctgggctttattggctggtagattattgattacttcctcgatttcagaacttgttattgttttattcggggatttgacttcttcctggcttagacttgggagggtgtatgtgtccaggaatttatccatttcttctagattttctagtttatttgcatagaggtgtttatagtatcctctgatggtagtttgtatttctgtgggattggtggtgatatcccctttatcattttttactgcatctatttgattcttctctcttttcttctttattagtctggctagcggtctaactattttgttgagtttttcaataaaccagctcctggtttcattgattttttgaagggtttttcgtgtctctatctccttcagttctgctctgatcttagctatttcatgtcttttgctagcttttgaatttgtttgctgtttcttctctagttcttttaattgtgatgttagggtgtcaattttagatctttcctgctttctcttgtgggcatttagtgctataaatttccctctaaacactgctttaaatggaaagaagacactccttaaatgacttggtgggagcttttattttatcaatttctctctgataaattatactggtagtcatatctggtcacggataaactttatttcgtttttgactgtcaggcatgttgaattcaaattgcatgccaaaccataacatttaggaaaacatcatatctctagagttataattgatttgtgctaatgatatgttagtagaaaagaatgacagtttgatttctttcattcaaaggaaaatctctacagtaaggaagaaagtatcatggctaaaagtcacttttatttaatctcaggttttatcaaaatatttacagaacactttgtctttgtcacctgctagtcattcagtatatttcaatgacgacagtattatctttggaatcacaaaaatatgatgtaaaagaaaacttttctagagtagagtgaatgcttaaaaatataatatatatccaataaatgaattacagttaggaatgttgacatgattaagaacgcttgcattactgatagtgacctctgccctattataactttatagctaaaaagtttaagatctttcacagtttctccttcagtaatcctttttccaaactgaatttcgagtgcctagtaacttgtgatttttctaggaaaaacccatggtctttacctgtttgttctatagataacaccctataacttgcttttttcacttaacaaaaaataatagatatatcatttatataacagatataaggcatactatacattatatataatataaatgtacatataaataaaaataaatataaatgtctggaagtgttcatatcttaaatgttttctggcagggatggggagaagagggttgtataatcttcaaatttttactgaatacgttcctttgccattattttctgttacaataagaatatattttattgtaaaataagtaaaaacaaattaattaaaaatggtacgtgatgataaaaacagtagttcttagaaatattatcaatattggaatcaaaacacataagactattaaacatgtgtatttaagtaaactgcacattatatccagaaaattgaatctaactggttatcatgcaaatgaagaaggtaatcagttcaaaaatgacatagtaactgatattgccttcctgttcttatttcttattcatggaaaacgaggacaagatatgaagggtttagggatctaggtcattggcccgggatttggcattaattcttctcatacaagcacagggaacgatcaatcagtgttgacagctctaatgccatcgttggagcagaagatgagccaaaggaaattatgagtttcttataaatgtgtcttaagtatctggaaatcatactttgtatcttatggcttgaatagaatacgtttgcttttaatgatttgtacagtgagaagattaaaatttctaccaacatatccaaagcactgatacatctattaaactgtttgcaacaaaaatacctatacctttttgaatttgaataaaaaatcccatttaaacaaccactgggatgtgattatgccccaaatctctctgattatagttggtttgctttattatattccacttgaaaattttgaattgacaagagggatgtttctgtgaactacagattttagaggaaaataagactaaagttttttgtatcactgtttggtgtttagcatttttcaaccagtaaattgtctttaaccaaaaaatttgtctcagagaatggaaaaagaaatgtgatgacaaaaaaaataatgcaaaaaataaacagttatgaaacagtatagagataaaaaaatcaaaggtgagatatcccaaaccatgaactatttatcttaatcatgcagccttttcatctctgaaagaatctattaatgtcatattcaaatgcttaatgttcactagcagttgataattatgatgaccatccctgtcactacaagatccttaagtgccttttgatgagcaaagaaaaataaaatcatattcaagtaccaactgttggaattcgtactttaaatacaacctgagaaatggccttaggttaaggctaatggtgtataacttgctcacatttctaaagagtatattttctgacaatgattccatatagaaagtttaccgcagataatagtttcttcatatttgcatcctgacctaatttttggtcattaggttactttttataggtatcaatattttccaagtcctagagaaaaatgagagttttaattttctcttataacctagctaccagatgctatgtggcaaggacagtcttaggatgaaattgtccagacaaacaaatatgtattagccatcaaatgtacacatatgctcataagtatgtgtacacatgcacaagcatgcatttacacacacaaacgtacacttcacagaattataccctgtattctgtcagcttgatggagtcccagctgttaaacctttgaggcattgtgacagaaatctgcaagaaagcttcactagaggcagatgagataatattctagctgcaggattcagctacattttcgattggagtcataggaaaaaacactcattgcaaaaatgaatgaaatcctaagcctggagtgcaatgaaattgtgtttaggctgtggggctcccttgattttttaatatcctattcactcaaggatgcttgtgtctgagcaaacatttctagcaaatccaccaatatatacaacactacttgtttttttttaatggaacattctgctaacatcgactatagtgattaagccatacttacacacttaacatactttacgaaataaagatacctgaagtacatgtagtaaccagtgctgctacatttgactagagatttagaagagttttgtttaagaccttttgaatattgactgactatacttatggggtacattaaaattcagtagcctctacattaccacacagcctatgctaaagtattttaaagtaaatttcagaaaagttaatgatttgtttttgttgacacttttaagaaccactaaaacctatgaatatggttggccttaagtagacactgtaaaatgaatgaggttgagagatattcatttaaagttctattagcctttatggaattattgtgagaagcccagcaatgttcagctcagtgttttacattcagatccatatttactttaacgagtatttcagaaagtttaatttctgagttgtctttggatgaatgagaaaataaaaggaattcagaattttatcaaccgtctatatctatgcagattatattcttttgtggacatatgtatgaaattcattcgttcatccagaaggatttattatgtgtatttcctatattctaggcaagcgcaaaaataatgaataggatctggcaactgcctcataaaatgtacagtctcctacaaatatgtagacaaggcaggtacaaaaaattgtgagcccttgtttattttagttttataagtaatgtgctcactactgatatccacctgaacaatttgattaacacaaaaaactggagaagtagattaaaaccatccaaaacattgggagatatagatagacagctgatagatagatagataatcatataaacatagatagtcatataaacatagggagattatatatatagataatatctatattatagaacatatatatgttataataatatgcaatgatatctatattatataatatatatactagaatgataaacaccgttattaggtgagctgagacaggaaggaggcgcgttggtttgcctctccagaccttgatctggctcagatggagctccagttccttgcactctagcacgtgtagccctctgctcagcacggccccatccttatgcgatgcacgacagaagctcgccctgctggaactgctcctccagaagactgctgtttgcggcattcattttcctttcattatatttttttctgaatttgttctggatcgttttttgtttaaaatctcttcctcctcaggagtccgctgggcccccttcttgtggcccggacggtgcacagtggagctcgcactgctgttgccaaggtgcgcggccggcagctcctcgccagggccccggtgcaggccggctggctgtgggtcacacgcagacaagatcagcgaccctcgttttgcgagtgcaacactcccagccacagaagttcccgggtccagcctcagagcccagtatttcccacggcctccccacacacaccccgcgtggatgcggcgagggcccgccttagtcctggcagtgcgcaccccagctcagactcccgcttcttgtggcagctccttctcttgcccctgtgccttctgctgcttgtgccagttgtcgtgagagatgcccggtgctgggcgctggttggaaagaaaaacttaggtatatattttctttttctttccttccttccttccttcctccttccttccttgctttctctcttttcttcctctttctttctctttctttcttttctctttctttctttcttattccttctctctctctctctttctttctttttctccttcctcttccttccttctttccttccttccttcctttttttgaaacggtctcactctgttgcccaggcagaatcatagctcactctagcccgaaactctggggctcaagcaatcctccaaccttggcctcctgagaagctgggagtataggcacgtaccctatgccttgctaatttaaaaaaagaaaatctttgtagagatggggcctcactatgttgcccaaactggtcttgaactcctggccttaggtgatcctccagcctcagtttctcaaagtgctaggaatacaagcatgaggcactgcacttgatcctatgtttttctaattagttttctacttttaaatgtaactgtaagttgtaatcaaacattatatatattatcctttaaaaaattctgaatttattgttatggttaaatttttatcattagtttccagactcaatgagagtcatttttctattaatggaaaataagggacagacctttcagcttacctggaagtgcctcatttcttttttgaaaattcctgccatggtactgatcaatgttgatatatatgtgaaaaaaataaagaggagacaaacagaggggatggtatttaataacaagagaatagtagagaaggagagaagacagttttaaaaatgagcattcatgggttgggcacagtggctagcactttgggaggtcgaggtgggaggatcatttaaggccaggagtttgggaacagcctggacagcatagtgagacccctatctctataattttttttttaattagctgcatgtggtggcggatgcctatagtatcccagctactagagaggctgaggcaggatgctcacttgagccaagagtttaagactgagtgatttcaccactgctgttatcagtctgctgtgattttaggtgtccaaggtgggagtgagtgatgaaaatctgaaaaagaattaagaggatgttctctttaatttacaaatatatttttgaagttgattttttgttatagcttagaaatctgtcatatattattattgcttcctctcacatattgcagtttttctttccaggaagatttcattttttagtgttgttttaggttcacagcaaaattgggcagaacgtgcagaaatttctctcatactaccggttctgcatatgcacagcctctccgttatcaacaccaccagcagtgtgcatttgttacaactgatgaacctacattgacatatcaataacgccccaaatctatagtttacattcgggtttcttttggtgtatacattctacgggttttgacaaaggtatagtgacacatatccacaattgtagtatcatacaaagtagtttcactgccgtaaaaatcctgtcctcctattcattccctcttctcccttaacccctcacaaccacttatctttttactttctcaatagttttgccttttccagagtgtcgtgtagttagaatcaaacagtatctggtgttttcaaattggcctgttcacttaatgtgcctttaggtttccttcacctcttttcatggctgatagctcatttctttttaccactgatattccattgtctggacacagtatagtttatttatccatttacctaccaaagaatatcttggtgactttcaaattttgataaatataaataaagctgttaaacatccatgtacaagttttttgtggacataagttttcaactcctttgggtaaaaaccaaagagttcaatggctggatcacatgtgagagtttgtttagttttgggggaagccatcaaactgtactccattgtgactgcttcaatagtaatgcatatactatatccacaatttattgaccacacaacttttttttttttttttttacccagcatactatagcatcagtatctgtcacagtgagggtttgcacttttcaggtagggctgttcttccttgggcaggactgtgctgagccctgcaggtcgtttattatccacggctcctgcccactggatgcaaatagcactgcccagtcatgtgacaaccccagctgctcccacataatccaaatatcacctggaggagagatagcaccttggttgtaatccaaaaggctagaggaacacaaacaggtcttaccctcttatgagctggccatgtgggatgctccaggagtgaagctagtggaatgtttttagtgactgaaagtccttaagaaatgtgaaaagtggttacctggatttatacatatgtaaaagtttgctgagctgtacacttaagttttgtgcattttagtacatctgagatttttatttaatttgaaaaatagtccctacaggaatttcacagctatataagttgttttctgagaaataactcagaaaataacttaatgttgggattattctccatccctgtagtcaaatgaccatgaatttccgtaattttctttcttagtctccactgtgaaacaatttgaattagatgtcattacagtatactattttttaagaatcttacatgtataggtgggaaaacaaaaacatgtatatacataagtttttatataacctgtatgtatatataggttatattcaattatattccagttagagttcaaccacagtaatttgctatttaaataaatgatattattaatgatattagtttatcccacatcattattaactaaagctgacattttcccaataaaatcaatttgcttataataacatcgacattcctttgatctactgtgtacaaaatgtgccagctctgcagggatgatgagttaacactctaagcagttcttttgtcgtgtcactgcggtgttatgagacatgaaagagtgtttgaatggatatggctataatgcacagtgtttcctttgttttcagagtaaaagccattaacagttatttcaggattactgtgtttatgacacttgtaaattgatttatggtattagccaggcaggtgattgaacaaaagccttttaatgtttgtgtatgtgtttatccttctcagcttcacaatgttgagtgattcagatcacacttcaggcttatggaaatttgctggacctcctccccataagaactgattccaaaccaggggaatagtttaacctagcctgataatcacataaaaaggagtttcataaagggacacttgaggtcagagagaagtgaaggtgacatccactccatcatgaaaatgtcaaatggctttatataagacatcttgcttgatgcagctcagtgattcttaagccattttatcatggagagaaaagaaaatttaaacatttccgagttatagcactgtctcagactattatacaaatccattgagttatttttaaaactataatttggatgccagtgtcataaaatatctcttcctgctggctataataaaagttgttgatctatttcaagcatcctgagtagaaaaatgttgtttaatgattttgcatgcatgaagttaatttctacctctggaactcatagtagctgaaacaacttaatgctgtttcttagtgaagaggaatgtcaacgtagcatgcttttttttcccttcttttttggctgtgtgcattccatgttgtcaatgaaaatggcagatggactgtcactgacatttctgctttgtgtagttgctgccatagaaatgaaaaagtttttaaaatggtgacgataagagtcaccttttgttcactgaatttgctgtgttatattttcttcttggaaatttgacctaaaactgtttgtgaataattattcagaaaaaatgtcaaggatttttaaaaatcactaaaataaaatgtgctatgtcaaaccagctgcctttctaagctgctttttgcccatgtatcacactcatcagattctatttccctctaggataaagtagaaacctctttttttaaattccagcatataaatttgaataatgttatttgcaaaagggaaaatcgaagcatttactattcattagagccattagagaaccatagtgccaaaggttttgtgtaaacatgacatcatgactgttaggtgaaaaaaacaagtgattattaggaaatgattattattcagagtacattaacaatagccttgggtctttaaagtaattttaaaataatttgttttagtgttcagtttataatggtggaatgatctataattgtccaaagtgaaaacttagtcttaaccatttgtatgcattgttgcctttctatgctttattattggaatttaaacagtctccagtggaaacataatgcaaagttggtgaattaaggatcaaagcattaaagaaaaatgaacaggcatcatgtatactaacagctaccaagacttaaatgatggtgtactataaaatgggcttacattttctttaggtgggctataactttcaaaactcttaaaccaagaaagaaaaagcaatgagttacattagttgcttaaactaaatatgcagaacatacacactgatgtttaaagaaaccccacattttctcatcttgttccaatagaagaggtgcagacagtatggtagctttaagaaagtctttttttctgtttgttttttatttttattttagatgtatggcagcaggcattctcaagattttgtctaccttttgcctaaagaatctccttactgctgttgaaatattttaggctgatttctgatttccaaagactgaataaacattaaaaatgtttccattaggaaaatgttaaaatgcacccccaatagaaagattagcataacctccccccaatcttgcactctctctctttctctctctctctctatgtgtatatatatatatatatatatatatatatatatatatatatctgcttcagcaatattcattattgcatcaatttgtttattctatctcttctacctaaattagctatttctaccttgaaaaccatcccaaaacactgattcaataaaggaaacatttattattgttcctaagtctactgtttctttgggagattctgctgaacttagccagtcttgactgatactgaccagctggttctagcatctgtgttcagctgacaggttagtagggcagtctcatctaggatggctgccattttacgtttagtggctggctggctgttggccaggatgatggggatgatgggcaaaatgtctcttatcttccaacagggtagtgcaggcttctttttaaaatagctgagcagagttttcagagacagagagaaagaggaaaaaggtgcaaggcttcttgaggcctagactagaattcatcctagggtcaaaagcctaccagattcaagaagtgaggaaatagcttcttaggaggagctacaaagtcttattacagagagtgtgaccacaaagaggggaagagaatcagagaagattttgcaatcaatctactacactctcacacttttggggagagtattttatatcaatcaatatcatttcaccactatatactttagagaatttgcctttattttgtaagttgttatgattttgtaactctaatagcatccacaaagttaaccatgctccttggatcagaatattagtaggagggactatatcctcattgccactatcaacacaatgatcatcactttcactagtattagcaaattttatttatttttctctgctaatgacacattacctcacttaaatctcataagtgtgctatacagcagcaactatcaccccagtttgtacagctgagtgagcaggctgggtaaactgcccacagccatctagcaatggtggctttgaacccaggtcatactaactttcccatggtctcatcactgcacatcactttgtcatgtgaccagtcaggaggccacagtagctttgcacttacttgggaggccaagtagaatggacaaagacttagccatctctctcctccatttctcaaggaataatatgaatttaaattaagggagcaagttgtttctagatttgccaccatggagcacttttaaaaacatcaaggggatctatgtggtcactttataatactcatgatgtgtatgttagaggcttctgttttgaagaggcaaagaattttatttcctttttgttgtgttggaagttgccctaggaggtacgcacgcttgtccatgttaaactaatgtcttgaaatcagtgtattcttaattcttatcccactagtcgtactggagaacctgagggagtcaggaaggttccattgcattgaagcgactgcattgtctggggtaaatacctggggttcattgtctcatgtcaagaaaatttagaacatggacacatatgaggagtttagaagcagaggtttaataggcaaaagaaagagaaagaaagataaaggaaaacaactctctctctagtgagagagaggggcttcccagaggaaaaggctggcctgctgcggatgcactatattttatagacaggcttgaggaggtggtgtctgatttatgcagggcccacagattggttcgatcaggtgtgacgtttacatagtgtgcagaaaaggcttgccaccctactcttattaccctaatcttatgtgaatgggctttccagttgaccggtgccatcttgtctgctccttactgtacatgtggctgggaagggaagatggagccaccatttttgaacatgattggcacaactgccagggtctatgtctgcagctctattttacaggttgctctttgttagaaaataatttgggggctgcatttcattgaaaaggaaaaccttaccgaggactctagtaccctcactatctgcctaagtaatttcttcttaactcctatgtcagtaagatgtgacagtaagatatgtattatgttggtgcaaaagttattgtggcttttgatggcaaaaaccacaataacttttgcaccaagctaaatttttcttttgaagtggttggcagggatgttttttttcctaaggatgagctacgatcgtaggaattaaaatttaacccagtttacccagattcataaaaattaatagatttctttgtggatctgagttgatatcattaatataagctatcagacatcagcttcatgtgacttaacttcaaaaatattttagtaagagtatgactggaatgtttataacacaaagaaatgataaatgcttcaggtgatggataccccaattaccctgatgtaattattccacattgtatgcctgtatcaaaacatctcatgtaccctataaatactagatactcatagaaagtaaaaattttaaaaaaattagttcttgtcttagtgccagctccatcctgagtttcaacaattgctattatctttgaggtctagcatgaggcattaaatgccattgtttcaagaaagataaatgggaatataattttattgctatcttactgttgcaaaatggaattcctaagaaacataccctttatgaattctggcaatgaaactaagactgactttccgttttcaatctgaaagctattttggagctttcatcgtcagctaatggagtcttacttgaacggggtcacatttaaacttctaataatttttatgttgtagcctgtgaacatacaaatttcaggtaaattgaagctaattcctgcaggaggtaaggtcatatgtagaattagtcattattcatattctgaaaagtgatgatgtcattatgggagagaatttcttgggtcaagaccatgcatttaaaacgattaaaattcaaaaaatgggatcaccattactgaataattagtatctataagctactttactaaaattagagaccagtgaacttactgccctaagtcaagagattaatggaaattgagagtgttctcacttatttggctatctagttattcttgttccctatttcagaggtgagatgatgttaaatattaatctggaaatacgatctcctagtagcataatacttgggaaagtcttgctccttacaaataaaaggcaactcataaaacacatacatgagatgctcttaaagccatcagcattgaaaactaatggaaccgagtattaaataataactagattgcaagtaaagattgatatataataaacaatgactttagatgactattaccaaactgtttcagaaaaaaaaaaaaacaggaaaaagaaaattcgaaggggcagggcattgatattttcctcaaaattttcatattaataatagctacatggtttaatgtctcccaactttgtacaaatacgtaggactcaccttttgtagttaaggcagtattttgctttttataatgaaagcatttttccatgttttatttcattgattaggataactcatttcatcagaagagtagtgtcaattaacatagtgacacattgaacatatatgttaaatttaccagtagaagttaaattacaagtataagttatttgtcattagaaaatattctgaagcatacatgagtcattttttccaattcccattttaagatgggtcagttgaggtcagccagagtagaataatgccattactctaattcaggacaaagattcacaacttttttggaggtgggagggtagtattttcttttatgattaatataattttgttctcaaagtaaagcataaacagtgttgctgttccttaagactgctaaaactgtgaaacaacagccattagttactactttaaattttaccaatcggtacatatatacaaaagatacaggtctataatatcttaagatgcaatttaaagtgaaataataaagcggaaatacttagaatttaatgtaagtttaaagactttactatctctgtgttagctaacttttttcaccagttctaagtgaacacatagagtaattgatttttagaaaacaaaacaaaattacatacctgaaagactaattctcacattttggagcaaattattgtattattacctgcaagaatacatgatagacaatgtataaacaatgtttagacatctattaacacaatgtttcagaaaaaaattgaaattgtaagagaaagtaaaaaaaattaaaaccttaattcttattctatttctgtaaactttgaaatgaataaatattctgtttaaatgagaagcatcttacgcctttgtcttctgcttgaaccaaactcacatttgtaaatttcagttaaaatggtggcctttattcttttgttctttattatttctttcctctatcttgctggaactatccatcttctattagtgtgaaaactttgaagatgaaaagctatttcaccggaaaaatcattgatgtatttgtgatccttaataatgactcaaatgggaatagatatctaatatgaggaactgagtaaaaaagaaccactttttaaataaaattaactaaatgaagttattgtcttagccattaacactcatcagtcatatacaccatggaatactacacagccatataaagaacaaaattgtgtccttgcagcaacatggatgcacctggaggtcattattctaagcaaattaactcaggaccagaaaaccaaataccacatgttctcatttagaagtggaagtccaacactgaatacacacggacataaagataagaataatagaatattatggacataaagataagaataatagaatattatggacataaagataagaataatagaataattgtggactactagatgggggagggtaagaaggagtgaggattgaaaaactacctatcgggtgctatgctcattacctgagtgatggaatcatgtatacaccaagattcagtggcactcaatttacctatgtaacaaacctgcaaagttacctcctgaatctaaaatagaagttgagaataaaaaagaaaaaccactcatgtgtataatatcataccttccaagtaaaacttcctctgacttaggattttttggaatagtctgtggtttacaatagagtatatattcgctgtcctttattttacatacaaagaggaaaaactaatttcattcatgcggagttatgagagaacagtttcataaggaggaaacatactgccaaaccaaaaaaaaaaaaaaaaaaagaaggtatttaatttgttctgttgaaattttagagtttgtgaactaacatgttattctgtttgtgtttttagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaactggggaagttttcaaaaacctagatgtgaatatatttgaatgtcacttatacccttggtgttagttgttgctagaaatctgtctatgacactgaataataaatgtgaaagcctaatggagaagagtgaaaagatagatgctgtgatatgcttgctttgctgatgcaaatggattaatagtggcattagatagaaaggaaattgatctcatctagacttggttataatgggatttccaaacattcttttgtttttgtttttttttttttttttgagacggggtcttgctctgtcgcccaggctggagggcagtggcacaatctctgctcactgcaagctccgcctcccgggttcccgccattctcctgcctcagcctcccgagtagctgggaccacaggcgcccgccaccacgcccggctaatttttttatatatattttttaaattatactttaagttctagggtacatgtgcacaatgtgcaggttagttacatatgtatacgtgtgccatgctggtgtgctgcacccattaactcatcatttacattaggtatgtctcccaatgctatccctcccctctccccccaccccacaacaggccccggtgtgtgatgtcccccttcctatgtccaagtgttctcattgttcaattcccacttatgagtgagaacatgcaatgtttggttttttgtccttgcgataatttgctgataatgatggttttcagcttcaaccatgtccctacaaaggacatgaactcatcatttttatggcttcatagtattccatggtgtatatgtgccacattttcttaatccagtctatcattgttggttccaggacatttgggttggttgcaggtctttactattgtgaatagtgacacaataaacatatgtgtgcatgtgtcttcatagcagcatgatttataatcctttgggtatatacccagtaatgggatggctgggtcaaatggtatttctagttctagatccctgaggaataacactgtcttccacaatggttgaaccagtttacagtcccaccaacagtttgaaagtgttcctatttctccacatcctctccagcacctttttttggcatttttagtagagacggggtttcaccatgttagccaggatggtctcgatctcctgaccttgtgatccgcccacctcggcctcccaaagtgcaaacattcttgaaattctgcttagctagactgttatgtgcaagttgattctgatccctttgcagagaggccattcaggatcaagtccagtcttgttgaaacaaagttaagtgatttttggttttggtgttgatgaagtacccatgtgaaatatattggcaagataaaggagtgtaattacctcatttaccgaaaaaaatatttttttaatttacttttaaaaatattactgttgtccaaactcagcaatgctaatgtttgtcaccagataaacacagtaaatgccactggttggatttatttttaaatggagtcatttctttatctgaattgaggtagacttcatgttagctgctgtgttatagtaattaaagttcacatttatctgtgagtgttaaaattttcactttttatcgtgccatcaaactcactaaatagtttcagagtcaaaggataagacataaaaaattcctgaaaaattaatgccatttatatatcttctaaaaccttaaatttattgatgtataagtatgcgtccctgttttccaatattcattttgtatttagttaaaagctgttctgaagatttatggcacgcgatagcagttttggtagagttataaattttcttttcttttttattgttggtgccttagaagccagttgaattacaaatttacattttcagaattagaattgtataatctagatttaattaatgcaaggatgataatgcttcagtggcagtactatctgttcgaattgctaggttttttttaacgctctcagggagcagctctccaattagggatttatacatcttattaattaactactttacaatagatattatccagtgaactgtgtattcatattagggactgtatagtttgcttgttatcgaagtggattacatgccctttccattttctaatccatattttatttcctctgctgcctcttgtatctgagtatagatagattcaccaactacccaacagcaccactgacttcaatgccagtgtttactgggcttaagttacagcgaataaaactaaataagtggttcaatttggagatttgggtacataaacgttttgtatattactatgccttatgtctataaggtgtactttctgcaaaatgttttccatagcatttgatgtcaatcaaagccgaggctttaccaaatagctggcatgatgttttatctacaagctcttaatgtagtgaatatactaaacatactttcccgacttttgagggaaatttcatgctacctatagcaaaaatgtgattcaaagatggttgctatttcaaaaatgtttccagagactttctaaaaggaatcttatagaacgagttgagcaagaggaaacccactaaaggactgtcacatggctgaatgtataaagagaaccaaagtctgccttccgaaattgcaaaggcagtgtaatagccacaccgccccctgcaatgttaagccttggaaggtccttgaatttagacaaaaagcaattcactgtaaccagctggtgcatcgataagagaaatgtcagcaaattccctcaacctctaaaggcatggatgggggttgaggggctataggacaaatatataggaagtgcacaaagcttctcaagaagaaattttacagtaaatgagtaaacctttatatttccaagaacaatgaaaatcggttgtgaatcataatttaagaatgaaacatacaaataaataccttctaatgaattccatcaagttgggactgttataactgccttcctaagatccttctcctccacaagagactgtgtaattctataatgcaaattcccccaccaaaagttgaaagatatcaatgtaatgctcaggaagaatacattttgaatatccttataaatatcaatacttccataaaaatattaaactttggtgttagatttcaaattctgcacaattctgacttatattctgattataactgcattgctcttttaagaaattgactccagtgtggggaggaaacaataggttgaaatattgacaagtctcatttcctacatcaattccatttcatttaaatttttatttaatgggagtaatttcaatgtggctggctctttttgcaacttaaagtggtcaaatttggctttccattgcattcttaccattttctccatatgggctgggaagtttttatttagtgtggttaatgcactggctggaatatttgccaatcacattcaaggccttcccaataaagcgagagatagagaatatgcaaccgcccaaagtgaaatcagtgtttggagaaaaagatttcacatctatcaaagctaaagcaagaaaatcctgtgactctgggtttatatctctgctcagagaaatatgcacaagtatgttattgccttattgttgtcgcataacaaaaacattattgtctggggtttcaaaatgcagaaatatttttaaagttgtgtaaagatgcacaccagtttcttaatagtatttaactctgaaggggagatgtaagaaccaggatctgtagcatagaatttatttaaattgctgaattttgaaaaaaaagaacatattaagatatttgttgttatagtcaaagttaattttaaaataacacattaaaatgattttttacaccaggtgttccaaaattcccaaaagaaaaaattgaccctcttgaagtggaggagggagatccaattgtcctcccatgcaatcctcccaaaggcctcccacctttacacatttattggatgaatattggtaagtaatgctccgttccatcaaaaaagggggacattttaattctatccatcatatcaataacataatgaatccaaagacaaaataaaaaataaagatctcttaattttttcatatttgaagaggagatgctactaatatgataagatttgtctgtgaagacaatacttcctatatttcaaacagtgcacttacctttggaatatagatcatgtgaaagctgaggatggcatgggtttgtgttgctagcttcatctttctattttagtaatgctctacctgctaattgcagtcacctaccaggaaattagtattaacttttttgcttaattttctaaaaggtttgctgactctgatctgaaaatctagctttgtaaagtctacttctagcatatgccttagcagtgatctctacatgttttctcattgtgaaccatagagaaaaatgctatttgcacagcactcagaagaaagcaaatgaagctactcttaggtacagccaattgttccagacatcagttcccctagaaccttccaggctgcaaccagaacagggagattaatatcacggataaaacttttggagagctttttgttttttctttttaaatcatgttttaaataaacgtgattctcagaaaatacaagtgttaattaggtcattgtctgcattgatcagttttcagttcagccaattcagattcatagggcagaggtggagacaaagatggtaaacagagtttaccactgtttgtctactggtggacttctttggttaatggtaaaaagtatcctcccaagggttttgctgctgtttttgttttgttttgttttcctatttgctcattgttcctgtagtaagaccagacttgagaggaattaaagagcaaacaggaaaaaccaaatgaaataataatgtaaaagaaaatgaaaaaggaagatgaagcacagtaagggacaattgcccttttcaatggcaagatatctcttttcagaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttgtaagtccacataatttatcgtttcatcatgtatgctgaatgcaaatgtgtctgtaatttccttctggctgaagccatttaaagctgggttgatattttgcaccattgtgcagttcaactctggagacttcttccagatgaaatagacatctgcagctgcagattcacggtagctctgtctctcacagccaggaaatcacatctcaattcacaggacaaatgtatttcatctgacatctgcaggatcttgtcattttcagtggatgaaatatacaatgaaattccagggttttctaagcaaatcttgggcatcgattcactgtgatcttggataaactggcagactgaaaatgggggagaaaacaacagaggcaaaaagatggaaatttgtatcaccaaactggcaaacttacttgaatcaccctttcccgacttgattctgtggaggccagcctgggttcccaaatgggaagagtaattagagggaggaagaaccgtaagattcaaagggaagaaataatccccaacagtttgctgagcgaataattggccctggtatagttgaaagttggcattaccatttcattgtttaatttggtccatgattttttcatttttatgtgtagatatgccatgccagggcttcactataacattcttctagtagcctcagttctcttcagtggagctataacttgaatcttctccacctggattcaagattaaactcactataattattttctatgtaaaactatattcccaaaggcaatgttctagtgaagcatggttctacatcattttgtaatttttctaagacaaaaatatgacttttcattctttattgatatcagcatccaccattatgtttgtgttttttccttccgtttttttatttcagtaaagcatgctaatgactcaagttcatccacagaaattggttccaagggtaagttgaacccatgtggagtgttggcatttgtgtatagctcattgtcatctcagattttgaattttttctttaatatcctcttaagtttattacaatactgttattatgaaaaacatctgaacttagagggttctattgccccccatgccctcttaaatatatgcaaagggagtgatttttataaatatataactgtataaatataatgaaatacttatatataatgcattgaatagacagatagagatatttaatggagtaattattttgggtctcccaaaacgtctcttatggtatataaggttgatacttttgcagaaagaaaagaaatggttaagtgtcaaaagacgtagagaaaacactgcgtttaagaaagttaagtggatttttttcttgcaaggctttttgaaatatttgacatgcaactgtacattgtggctttctgagaaaaaaacagtttgtagcatttttcaagttcatgtgtctgcgtgatctttttatttaattctttcccccatagaacgtctaccagaacttgtgttctatggaaaatgcctgagtaaatctgagttgtatagcaggctagttctctataatgagaagagtcagttacataattgcagcaaatattctctataaaatgtggaccagtgataacttagataccttgcatacttgcaagttcagtggaggaggatgtaagctccttttgaagaaccgtcagttttaaggtggactgattcatccccaacatcatttcctttgagattaataactcacacatatatagtgctatattttcacagcactcaatgaaaaatcattgcacatagtacatattcaacaattatttttcaaaaaataaacacgaagtatagaagactgtctactgctaaagtccctttgaagatggaagtcttctaatttgccattgtatttgaaaaatattcttaagaaaataagaaatgggacacttcaatatgcaggtagtgaggatgcttactagtcatttcctaaaactgtgtttttctttaaggagctgagactacaggtagagttgccgaaagagcttgataaattcatagatgcctagtgtctaccacagccttcctcagtgagaatttctgagtgcaggagtgaggaagctgtttttagcagaaacctcgttaaattcttaggcaatttaaattaaataaaaacataaacataaagtcattgcacatgacatgattgaagtatagaatataaaatcatagattttcaattaaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcctcaaaggggaaatcttgctgcttgagtgttttgctgaaggcttgtgagtaacctgactctcactcatgactttgtccatccagttctgtaaagaataagacatcaagcacattaagactgtgcttgcaaagatattttaaaattatttccttaaaaaaattaaattctgccgggcactgcagatattctgctcaggactgttattccaggtacttaagaggctgaagcaggaagattgcttgagcccaggagttggaggctgcagtgagctatgataatgccattgcactaaaacctggatgacagagaaagacctcatctaaaataaaatgaaattaaaattaataaaataaaataaataataaacataaattctgtcattatatctctggaggaagtaatttgtacttcactctacagacttcaggcagtaacaggctcataaaattagatctctctgtcaatttatgatattgtggatggaggggatgatgataacattctccttagttaagtttaagaagcctgaggttgttggtagtcagtccctcacttttggtgctgagttttctctctatgctatactacttgccccactcctgtttgctatgttacttactaaatctgctgctttgcaggttccaaggagccctatttatatctatttttactctgctgccctttgcacacatggaggtccagaccatgtaatttaagagagttttacatcaaaatctaattaagtgaactttctttacacctgaaaaagcaatccatttatttatttatttatttatttaattatttattcatttattcatttatttatttttttgagacagggtctcactctgtcacccatgctggagtgcagaggcgcgatctcagctcactgcaacctctgcctcctgggttcaagcgattctcctgcctcagcctcctgagtagctgaagctacaggtgtgtgccaccacacctggccagttttttgtatttttagtagagacagggtttcaacatgttagccaggaaggtctcgatctccggaccctgtgatccacctgagttggcctcccaaaatgctgggattataggcatgagccaccgggcccagcccgcaatgcacctttttaaatcctccaagaaaaccctaaaggacctcacttggtcacctcttaaaattgttccatttattaactactgttaagtacatgtaaacagggaccatcttatttaatatttaatcatacagggtctcctatttttaccactatccttccgaacttacggtccttccctaccattgaggataccttgggaaaatgcattccagcttcctagcacctgggattactcatttgaaatataatctgttcgtaagctaagggctttggggactctagttagtggactaggatttgaaattcaaaaaatcatattcattcataatttagagtacattctgaacgactggtttagaaatggagcagattttattggttttacagcccctaagctttgtaagtttctctttccaaccaccaaaaatatcaaagttgcttgtctgtcttcaactcccaatgtgtatttacataaattagttagaagtactatgacacagactctgtttggaatgtttggtctgtgtattattttagaagaggaaagtctcatattgagtttgaatcatgatggcaacaacctgctctactggttgtatttgtacatgtttacagtggtagaaattacattcttgcagagttcatcactgtattgagttgggcagggtgatcctttctgtaattcttttttcttatttcccacaaatgccttcactgacctcttggattgactagcaactgcgcagaatgtcttcaaaataatgaaatgctctcatgtgctttttagaaaatgaagagtcatgaaggaatatataaaaacagagtggatgaaaatatatgttgttgtgaggacatgaaaattcttgatgcgctgtcctaagacttttcacctgaagtagtttcttcttactcatactgattttgtgttgggtaatcctgtctgatctgggtcgtctctcagaagatgatacatttttaaaaagttttttgggtcctttaaaaaactctttctaagaagttttcaagccattaacctcctatagtaacaaaaataattataattaaagtattgtactattattttgtgtcaagcactatatttgggtctttgaaaactagtctaattgtctaatacattttacttgaaagaataaagtaaaatgattatctataagtgtcaggtgaacatgagatataatttatctcaagataggtctatatcttggcaagaatttccagctatattcttgcaaatgtttttcatttccttttgttttagatttaagggatatttaccaacagtatctgaacaaatgtgttttgagggaaaacttataaaatggccatagatggactcatgtgcactgctcaaatagtttttttttctgttttgtaaattcgtgggtttaaagtaggtataattctttcacaagatactactttataaatagagaaatatgcaaataaaagttggccagacaaggacctgaaaaaaattgagattatgaggtagtgtattttgtgtgcaaaaaggcattaagcaatatattttccctcaaaacacattgcttaaatgctgttagtaaatgttatttaaatttaaaaaaaggcaggaggtataaaaaaattggcaagaatagagctgaaaatttttgccatggtatagacctatcctgagattaaattatatctcattttcacataatactttagatcattattttactttattctttcaagtaaatggtattagaaaattagactagttttcaaagacccaaagactagggagtccgggagatcttgctgaaagtgagttacttgctctaataaaggatggactcttgaaaaaatcctgttttaggggaagtgagttccagagcagcctataacttggcaaattgtcattttgacagatggagtgaaaagccagcagttaggagacttgagctatgcatcctcttaggtggtgtgctcagaaagccagcagctaatatgctctcacagctgtctgcccaggcatcattaccatttcctacacaagcgtgccatgtgctcttagcctggtaaaatataagattattattccaggctgcacagcacgttagtgtttgaggcttgaaggaagaaggaaaagagtagatatatagagattaaagagccttcatctttacctccaattttttttgcataaataactgaattattttaaccacaaactatcaatacaaataatttgagaatattgacacacacgatttcaaggaattgctcaattattacatagtaactaatgggcaatttgacaggaagcatatattctaagactatagagttaggaaggacataggttgaaaagcacaaaataatagaacacactgataaaaaaggaacaagtttagagtagacaaatataagttggggtatatcatttattgctccagtgaccttaagaaattaatttattggagcttcagactccttactgttaaatgatcacaataatatgcccatctttagaactcaccaaataacctacagctactaataacaagaagaaatatggagaggaaaagtgttgcatcaataaaattagcaaagttgtttctcctactcacttatagaacctgactggggaagagaaagagacagtcatccttcatttagaaccaaccctttatgctttccacataatttttaaatcaaatgagtcacagaaggtatgacttctgcacttgtctgcttttcatgaggaggggtttttcttaatgtagctgccttgactccccagtccttttttcctccttactaaggtggggaaagttatcatgctggtgtgtaacaagttatcatgctggttttgttttgtctttactttcctgtttgttttgactgggtgagctaatcttttgaaagcgctaagcaagggaagatttggttcattcctcctttcctctgcttcccgacaagggcgagaacgtgatccaggaggcagtatctgtgctgcagattccagcttgccctggaataggctgttcatgggtctaatcgacatgtccagctttcacgcaggagccccattctccatgatcagcatcataggattaaaagggaaacttctctctgctgactgttaagtcccactttactgtgttttacacaaacagggaatagggctgttatcactggctgccccaaaccacccactgggagattttcacacttggaaaatatcttggtaatattatttcaatgagctccagctatttttccttcgctcagccacacctagtcagcacttacatgtagttagcccttgtaatagaggagagagaagacttccaaggagacagaccactggaggaactttcagtgaaagagacttgcttcaacaccagtgttcactattgttggtggtgggtgtgtctgtccactggtaaggatgacgtgattcagtggaatatgagcacatgtgtaaaagcaccctgataaaggatgtgtcctaaggttttctttgtattttactttccgcttttaaaaaaatgtttatttatttaactattttttgcaggccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaaggtacctttcccatgttggtctatttctctgcttttcaaaaaagtaactgtatacatgtagtaggccttgcttctaaatcatacatgttaaaacaggtcagcagtttcaacttttaattgtagtgcgggcattgaattatattacacttcaactaagcaggtttgtcatttacgccccaaaatgacatagaagggacaaatgacaagaaaagatctcatgttagggattaaacacagacagtttacatgatttattcaaatagtcattaaagctagtctcctaaattatttttattgtaatacacatatacatttcataatattaaatcataaaagcagcagtaaggattatgatgaaaggaagtattaaaatgagcctggaagaaagcttggatttaacttgctgtgccctttgccatttatttcactctccgtacctcaggctcttcaccaaagaagtgaaagaggcaggcaaattgttgtgtcagctctttcctgcatataacacttttgtaatccatatcttgggttcagatgataaattcagtatgttacttacaggcaaaaaagaatagactgtatgctataatattaattctctcaaaaagtgcaaaaacattatattcaagtcatcttctctctgtaaattcagagattttgatcaatcaaggttttattggtattagttacatttataggaataagtaggcaaagatgataccatttaaatgtggaatgtagttattagtgctgtgactggctgatgtgaagtttgtctagtcctctgaatgtgattgacacagactattttctgtggatccaatcacactgaggctttctatctacaatgtagttgaccgtattgatcaaattaatggaatgatgactgcatttgtacttatttagtgcagtgtaagcttagctactgaaaggaattattctttttagactacaatttagtgaactagtgctctaggcacccattaatattccagtaaagttcacctcttaaaactttagtttccacaaggaacacctaagtaatggcctgttgtttaaattaatggaaaaaaaaaaggactcagacacaaattctcctcccaagtaaatgttaacacagttgatttaggcaaacccctgtttggaataacactgcatttccaagccttctccataatgcatattattatttaaggtaggaagaatagaaaaccgaagttgagaattttattttctttgacttgacaaaagcaaaacttatatagatatgcattaacgtcaacatctgccaaacagtgatatattcctttgacattaaattattcacaaagaaattcaaggaagaagagtttgaaagatttatgttatgtatatttttagtcatcatttgatgtttctatataatttggctacatcgtgcaacaggggtatttttctgtaaccccctcctcccctccctggcacacacacacccacgaaccagacatatctaattgttagattctcctccaagttgctgactattagaaacacttccagatggctggaacatagctacggtagctgaatattttaacaatctggccacagttttcttgactataaaaccaaacctttcaaaagaattgcaagggttgcaaaaaacgaaatcaaagatgtaacattaattatgcaatttaaaatgttgactataggactccaaaggaatatagatttcctgaacaaattgttctcactactcataaaacagctattagcactattgagatgtaaatgatgtttttatgaagaacttttaatcctctctctttagtaagaaactattaaatgtaccttcagttgtatgtttttgaagtttctctttacctatacacatgaaaaacaaattgagcttaagaagtctttacttttttttctaaagtgtggaggtaataaataaaaactttgttaatcatctggatggatgagctcgtgtttattcaattttttctgccttcctgcaccctctccttttccttttttgtctcttttttagaagcccacattaaataataaggatttgccatgtgagaaaatagcaatgctattgtatattttgaaaatctactccattctgaaaacacccattgtgcttaagtaaaatcatggattcgattggattctttctgtatgtgcaatgtctttcctattaccaaacataatataatcaaatactatgagcttgtaatttaggttgcaacatcctaaatataaaatcagactgcacttcaaatcctataatatgtatgagcaaaagcagccaggatgtcttgactaggtacaactgtatattctaaatatctaagatatgattaattacacattcaataaaaagagatatattatagtgacatctaaaacagtctacatccagaaatcaaaatataatcacaatcacatttcaatagactatttaaaaataagctcccaccaataatttttatgttgtcaacttttgaattatttaaagcctttgaattttagtaagtgaaataggaaagcatttatatgtaattatagagccatagtataatccaaaatgtttttgcattttcaaaggttgtcataaaatcaaatgcaactcagtcattaatatacttgagaaatccttgttttcaaataacaaacctatttctaaaatgttgcgattaaatccaatttttgttgaacctaacaagttttgatttattaaaatatagattttaataagaacctgtgaagaaacagttttactaaaaataaccagtgttgtatgttctataggtaccaagtttgttttattttgtttttttcctagtgataaacatctctatttagcttgcttaatatatagtcccaatgttcagacatttgcatctgtttccagcaacatgagaaatatttatcatcttatttttgtatttacaattatgagaaaatgcataaagtttcaacataagcaattttcatctgttaccatatgtcttaggataatagataaaagaatgggtttctatgaggatggtatttttcctcagaatttttggttttaaggctcaagaagcagctgtttctgagcagaacaagcttgactcaagtccctcccaatattacatgattcaggaccagcttacttctataggagaaatggatgaaaagcattaaagtaaattttcaagcaattataaagaaagcttataaagaagggttaaggtaaagtatagtgaggaagcctagtgaatgctcagaacttcttgagtcagttgataaatattgggggagcttggatttggaagcataaattgggctggccttctttcctgtctttgatacaaattcataagataacactaaattagaaacaaaaaccacatgacttcagagtctaaatgctgctcatccatagttgctgtgtatttatctgtggaatggcgagaacaggaactggagcttcctttgctggtgggcctgggcaagttaggcaacttctccaaagctcagccctctgtctgtaagatgaaaggattggatgacgtgataatttggaacctctttcagtaatactaatattactaatagtcctaatagtaaatatcctaatggcaatagtaattattcaagaagatttacagaaatatcattattgcttgattttctttatttctgcatacgttgaaagcaatagttgtaattttctattataaatatgatatgccataatgttcatgttcatggaatatttttctctaacttacagatatttagttttatattggttgtattaaaataaccagaaaaaaagtaaggatatcattaaaaaaatgcaaaatagacaaaaataaaccttcacctcagaaaatgatcgcagtttataatttggactagtgtattttaaaccaagtgactaaacatttacaggtagtacagcttatgaatacagatatttaacttggaatttaacaattaagtccacaccctgtggagtaattacaaaggcacttatctcacttggacttgaacttgaacttgccaaggctagttgtgtacttttgtttcctctgatgaacttacagttctttcctttttacataatcctctttttcttcctttacttagaaaaattttaatgatattttttcattgtatacatacatatatctttgaagactttcgtttttagctaaaaatggaaatctaaaatatctttggggaaataaccaaactacacttgatgggagttgctacctgcaggttttgtgcaattttctctgaaatcaaattatccaaaccatcaacactttaatctaaaccttttagttacccctgacatagcaatattcatgaagttataaaacatagagttataaaaacatggaaatccagtaaaatgtgtcatctgtttctgacatactttgtagtattgttacactggagcattagggcatagaaagatacaggtaattttaaggtatattttgctgcattgttttgactgcagaaagctaaacactgcttttgggcttctctctctcccctcttacaaaaaaactctaggaaataatatttttcaagtagattatatgtataaatgctataagatcactaagaaatattcaaaataagcattaaatattttaattagttttatttttaaaattcttacaatataattcttgtgtatccacctttttagatgccatgctgcagcttgaaaataacctgtagtgagctctaaataaactcaccatctgcttattcttccctcattttttcctagtggggtagctacttgtatagctaaataaaatggttgtatataactattttcagtatgttgatgtatgatacatgctgagtccaaattaaacacaagcacacacacacacacacacacacacaccatacaacacaaaagcagctcccaccttgctttgcagagcaagtttaccaaaaagagctactatgaaaccctttgtggtgtctgccctctgctggtgcaaagtagaaatacaggccttaacatttttggactttttgacatagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacagtaagtttaaaaaccaattgcaatgcaatgctgaaggccctggtttgacgggattaatgatggtcagacgtgtgtaaaatgaagttggtatgtggttggattagcaggacagatacaaccagcaaatcagagattgtttatttctaagcaatttggttgttaagacttgatattcatggaagagccataaataatatttatactgcctgtgccctcttataaattatatataagaataaagatttttaatttttaaaaagaaaattgaatgagaaagaggatgcatccaaggaaaaaagccaattattgttcctgtccctgagaagaaacagaacagtagcctagcagctgagggcacaggttcaaagtcaggacctcctttaggctcaggcaacagcaacacctgtcctgggctctgcccttttaagggacttgctctgatcaccctctggtcccgcttgtctccatgatttgaaagcatcctcagggaaaaggaggcatcccaagtctgaacatggtcccattactgcctatttgctaccaacctcaagcacaaagacctgaaaatccccatgcccggtccaccctgagcccactccaaatgggctgggcggggaaagacaggaatggcccagcactgagggccaactctccccatttcaccatgctcagcatagagctccaaggagtccccaaatcttccactggaacctagagctcagattattttggatgtccttgttcaggaagaaggatagaacatatttttacgtgtcaattgcttaattaagagcaggtacgatagtggcttccatttgtccttttgctctggggcctgcacaagtcaagggtgagccacttggtggataacagacctcgggtcccgtctaggatgtgcaccttgccagctgtttcatcttgaggtgttttctgaatctccccaagcttacgttttttaaactgcaaaatggagatagtggcggttggttgtgcttgaatgaaaaaaaatgtggccagctgcctagggcagtgattcatctgtagagcactgtgatggtttataaactctggagccagactgcctgggtttgcatactgactctaccacttactagctgcgtgacggggagtatcactgaccctcttcaaacccatttcttcatcagtaaattgggataaaaataacactgactcacggggttgttttgtggattaaaggaaacatcatgcagagaatgcttagcacggggactgccacaaaaacagccccccgtaaggtatggttggttggtattgttttcccataacagacactcaggaaaccttagtcctcattattaactatcttcagatttgggatttttctcttcatctctttagggaacagaataaaaaatgaaaaataataatgaggttttgggtagacgaagggaaatgaaagcaacttttgtttataatgaatgttcaggttacaaaagtaaggaacgcagattctccggaacacaaaatcataaaatattatatttggatggtatttggctgtttacaaaagacattcacaaattacttagaatcctcaaaagaactttataaaggaggtgctattattcatatttaactgattcgttcattcaataatatttatggggtactttctatgttcccggcactggacttcatgcttgagatatacaacagtgaataaaatggatggaatccttgctctcctgccattagacaaataacacatgagtgtgtgctatggtgtgataaagcagaaaatagctgggtaagggcagtgcctgaaagaggttcaggacccagagttgcaatcttaagatcataatagtaagacccctgtggtaatttacctttgagtggagatgggaaggaagtgaggaagtcagccacctaaatagcagggaaagtgctgtctcagtggagaggtgtgttgaggaggagaaaagaggtgagtgtgactgaagctgagggagtgcaaggggcagccctaggccaccagatccgccagcaggggaaggggccagagctcaggtaaagatgaacatcgaagtagggccttgggattttgagaatacactaggcagctcttggagaattttaagcagaagagtgacacaatctaatttacatttttacaaggtattttcctggcctttgaatggagaatggactgtgtgattgatactaggtaggaggccatctgagaggctctgcgctcagggctagattggtggcagtcatggttggcttctggatttattttgaaattgagccaataggtttgttaatggatgaggaggtcaaggctgaaaataaacttatgcgagaccacacagctgaataatggtagacttcaaaccaaagccaggtggctggaatccaagctcggtgttctgttcacagcttttggccctggctctacttgttgccctgcaaacaggtcgtaaacttttataggctgggatatttgatgacagagtgttggctagaggatttgaaacctctttaagcttattttagttttagaggttatatatcctttccccatgttatttcaaaattaaatcaaaatgattgctattattgattatcggactaacccttttcacatgctttgcatatgatatttctgaacctcgtagcagcttgaaaaatagattctattattctccattggcaactgagactcagagaggttacattacttactggagaatgcaacccaggtacatttaaaaccaggaactaaacccaggaaggattaactccagagctgaagtttcgtccattttattgcatgatttctcacagggttgaccaaagacaaaactgagaaagaatttctgaagtatgtcaggactagtgtgttttataaagacttggccttcttgaatcctgggagcttctgttagcctttgtcaatacacaacaatttccatacccatgccaacaggcagatttaagcaatgtttaattacttaaataaagtatcatttatatagtctaatttcttacttttgtaatgcagtgttaattcagagccatgcatggatcagacgggataaggagaactaaatgggaggatggcgttaactctgaaagtcttaggaccctgagtggggtgtggaagtgaagagtgggattagagactcagtgctttgcagcattcctaaagagtttagcctttaaaaacttggaagagctactcatcttgctaatttgcaagaaataagtgataaattgttcaacaggattgtattagttttctaacattgctgtaacaaattaaattaccataaacttagtgtcttaaaatagtgcatgtacactattttacatttctgtaaaagtccaacacgagtcttggctaaaatcaaaatgtcagcagtgccatgtcctggaagtgcttggagagcattccttcgtttgccttttccagcttttccaggctgcccacattcctggctcccttccgccattttgaaagccagctacactgcatctctctgaccatccttccatggtcacatttccctctgaccatagccaaggagggccttctgattttcaggagctttgtgattacattgagcccacttgggtcatccagatgtaggaaataattttcctacctcaatgtccttaatcttaatcacatctgcaagtcccttttttccatgtaaagtaacaaagtcatacattctgggacttagaacgtgtacatctttcaggggctattgttttgcctacttacaggggcctttcaggaataaaggttacccaacctaacattttaagtcattccaataagtatttactggctggattttctctggtagctgctctttgggcagtggggacacactgcacaacctcacactcaggtcctgcccttagagagctcacagtcaagtgaaaaaaatcttcatttgtgactcctaggcagaaaaagatgtgtaagtcttttatttcaatatgtagtattcatgttttctagaacctaaagcttagtatagtcattatctcgtataatggagagacaatcagaaaagtagaattcgattgattattaatcttgtaatgtcctttaaactaaaaatttttgcatttgtgcccttcccttgacatttccagctaacatgttttccttcccactggatttatatatataaaatatatgttatatatatatatattatatacggatattatatataatataataatatatatttatatctatatatatactatagatatagataaagatatacacatacatagtatcatagcaagggcagggcttttagagtcagaaaagtggccaaatgttgtgggatgtgtcatccaacttctctgtaatccagtcccctcacctttaaaatggccatgtaaatgctgatccatcgagttctgagcagtgtcagtgagatcatgcatgtgccacatccagtagagtttttggtccttaaatgcatcagaaatgttaggtattcttttttttcttccttttctttttcttcacttttattttaaagtctctctccatcacccagtctggagtgcagtggcgagatcttggctcactgtaacctccacctcctgggttcaagtgattctcctgcctagcctcccaactagctggggttacaggagtgcaccaccacacctggctgatttttgtatttttagtggagacagggttttgccgtgttggctaggctggtcttgaactcctgacttcaagtgatccatctgcctcagcctcccaaagtgctgggattacaggtatgagccaccatgcccagcctcatgttaggtattctcatttccaaaagatattcccagaattatacttggatcaggagtggggaaggttttattgccccaaagtagaaaatctggccctttttctcaagaagagtttagtcttcctgggaaaatgaaatatacaagcaatgtacatgaagtggttaaatagtgaagcaaggcaaatgaaatcaatggtgcagatcagaaaactgtagagaggcagagaactgaaacgggaacaaaagcgtcaagggggaaaatagcagccagtactggtagctagggagatcgtgatgtgttgaccatgtgacttgtgccaggcagcatcagtgtctaaattcagaagagtaacagagtgtcacttcatcataggtcttgaatgcctaaaggataatccagaatagtgccatgagtataggtatggaaattctgggaggtccagatgagcagatattttgttgctaaatattaacttgaaagataattgaaaattcacatggatctggaaagaaaagtccatagttgatgttcagaaaacctaaagaattggcttcaatgaactattagtcaccctaaactggtttgaaaatataaatactgtgtgacacatttaataaatggtgtataaatattttatgtcctgttccttatcaaactgacattctttaatctctttcagatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtgggtgagtgtgcctgggagctgacttaacatgctattttcctaaggaaagtggtcaaggtcatgttcagaagtgtattaactcttgacacataatatatggagggaaaaatcaaactacttttcaccatacatttgagttttagacttcacactgaaattgtactttcttttttttttttattatactttaagttttagggtacatgtgcacaatgtgcaggttagttacatatgtatacatgtgccatgctggtgcgctgcacccactaactcgtcatctagcattaggtatatctcccgatgctatcccgccccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatagatggacatttgggttggttccaagtctttgctattgtgaataatgccgcaaaaaacatacgtgtgcaggtgtctttatagcagcatgatttatctttgacaaacctgagaaaaacaagcaatggggaaaggaatccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccagaagcaatggcaacaaaagacaaaattgacaaatgggatctaattaaaccaaagagcttctgcacagcaaaggaaactaccatcagagtgaacaggcaacctacaaaatgggagaaaatttttgcaacctactcatctgacaaagggctaatatccagaatctacaatgaactcaaacaaatttacaagaaattgtactttcaaaaatgtattgaattgggatacttctataattcaaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaattttaaaggtagttttggtttttcattatgaggtaccacaaggtcatgttttactctattgttgttgttttgggattatctaaatgattatctaagctcgaatttaattccaaatgcatgtgcttaagacttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatccttaaaaaaaaaaaagaaactcaagcagtcgcttattgtcaaatgtacagggtaaatcaagctgtagcagcaagggcttggaaatggctgaatgttggaggaaatggctctggggttgatagggtaaatgtaatccatgtccacaggacaggcaagactccccagcttataatatttctgaatgaccaatgttctcccaggacagcaggaggtttgaaaggttcattatctctttcaattactagctttcccatttagtaccctggagcaatcattaactaaagagttcaccatcaataagccagaaaatatttattaagctctgaggacacatgcaaaccggtgctggtggctatgacaaatacagcagaagcactgagcatggacttggattttctatagccacagtctatttgggtagataagatatacaatcttggtccattttgagaaaaatatgaaacccactggaacatttcatgaggttttctgagctattgaaaggggattagcctgaatgacgtcactgactagtattaaaaagcgtatacaattttgccctacctcagatggatgtacgctttctttgtccataggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtttttcaaaattcctagaatgggtttcatctaaaagattattgcaagaactacagggtatgcccatgatatgtgcacagcttcatcctattttaagaggcagccaggtgtctgtagtgacagatggctgtcaatatttaaaaattacctattaaccatactacaccatatttctgtaactatattttatttccaaagctaactcaaggtaatggtaacagtaatcaagtttttgagctaaagatttcacaaactcataactttataatgactgaggcatgacagaatgaggagggtttttgatcctctttttgagtcataaacagctttgtattattccttctcacttcagggcacagtcctgggagctgttaatagtttcttgggcttcactgatattttgattttaatattgctcagagaatcttcaagaaaacacaaaatggaaaggatcttcggtattaataaggagcatttttgtttcttctgtcgtgtccatatcccagcctgcttctcacttccacctagataagggagagcatatttgtttgatcatctgttttcactgatgccacttttcctcatacatatctgctgttgtatccactgatgtcttgacatttctttctctcttcccatatatatccttccttccttcttttttcatcctgttttccttttcttttgctgtacatccttttcttattttatagcatttgtctctttctgtgccctgagtaaatcagtgtgccagccccacagactatatttttaaagcactcaaatactctcccacaatatctacttatctctgatgtcttttacattttcaagtgtcatgtacacttttcaagatgccctcatgaagtcactgaagatggtgatgattgtttttatacttcaaaaagtaaacctatatcaaggttaagcaactcagctaggtgtaaggagcgtgaagcctcgaatccaaatggaactttgcactcctattgcccaatacagtgcttggcccaaaatggacctcaaaactgctagtggccagagagatggacaagtttagaaagtttcaatatgctgtagtgtctattttatatgttaaaaatatatacgaatcgtatcaatggaggattaaggacacttttttttttacatatacaaaaggcatgttgagaatggagttaagtgagagcctatatagtatagtgattgagagcatgagctttagtctcaggcagatttgggttcaaatcctggttcagcccattcccggttaggaaaccttgtcttatggctcaatttcattttagccttaaattattttctctgtaaggtgggagtattaatattcataaagttgttataattataaaatgccacaatgaatatgcattacttagcagagccctgatagagaagtgtttattaaattgtatctattattattaaatgaatttctggctttaaatttagaattagaagtaggatgtcaaataattcacttaaaattaattcaatttaatagtctcttcaagttttgtgcctggaataacaattaattttattaatactttccatttttagccagttccttgagaaaaatgtacatagccaatatcagagtataattatagaattggaggtcagcttgtgcagttggtctctgggaggtccccaaaatgccaaatgccacattaagagtatacttacttttaatagggcattaaagagtaaggattgcacgttttgaaacaatcataatgaaccaaacattttcttaaggcagccataaaccaatctttgagtttcataatgttgataactacaaatttatttttgtttcaaactatcactccctgtaattcattcaaaaggagacttaacactatgtattgaatgcctacggtgtacaggctcccttctaggctctggagacactgcagtgtcatgaaacagtcacaggccctacttccctgaggcttgctttctagttccccaccttcatgttaatagttcatccattcatgggcttaaacatttaccctcaggtttctgaattaataataaacaccctaacagaaaatcaaatatctttcccttttcctttacagtgctttgattatatatccagaagcacttgaaggagaaattatgttattttcaacttctagagacatttgtttgcttatactttgcttactcccttccccaagaaataatgagggaaattcctaaactattagttgatatttccacttaaattttgtcagatgtccaagcctggatggaaagaaaataataatgacatacaatgttaggaaattacagtgggacaaaccctgcatgaggattggacagttatggtgacaatttgggttacttaacttgcaggcacttaataacaaagtaagttacgcttagttctaactaatatctttgtttggtaaaaacagatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggtaggtaaactattatgatatgtcataatatttgcttggggtaaacaacttgcatttgatttaaaaagttctaggtcgggcatgctgactcacgcttgtaatcccagcactttgggagaccgaggcgagtggatcacttgaggtcaggagttcgagactagcctgaccaacacggtgaaaccccgtctccactaaaaatacaaaaattagccgggcatgatggcacgtgcctgtgatcccagctactcgagaggctggtgcacaagaatcacttgaactcaggaggcggaggttgtggtgagctgagatcacaccactgtactccagcctgggggacagagagagactctgtctcaaaaaaaaaaaaaaagttcttaaagcattcatacagaaacaaaaacaaaaactgagtaatatttctgtcttcaagtcacttcactctgctatcatatgtttatcatcctgtttttgctactgacttttcatgtaacatgtaccattctattagtgtgtgaaatggaaaccactctaagtaaccgaggaagaattgcatgggcttggatggttgcaaaaaaaaaaaaaaaaaactggaggagctaggcctagaagaggctgcatactagtcttctaggttcttgatcacaaagcactgcagctgcaatccaggtgtctggaaactgctgccatcttcatggccacctcaccccattggtactactcgtgagtcctgccactgccacctctcatgtctgccagaaccactgtctgctcccactggcccagagaagatggcatccattttccttctacttttcaatctcacatgagtttatttaactcactagcaaaacctaaatcatatctgggattcttcctgccagagagtactgagaagtacacctttgagtcttccaaactctgtatagagaatatagacaaaatataaaagagaacatatagaggaaagtgtgaatggatgcttaatagcactagatgatattaagtacatcaaagaaataaaaagtcagcatttgctgaatgtctactctcttttgaaaatatgagaaagtcagcttcgcgtccttttgcattgttactaagtaagggttaaaacttaaccatcttggagccaaatctcccctctcattaattttgtaatttattaccctgtaaaactacaaatctgaaaatgtttagataggacatgtgctgcttgcatgagacagcaacactgccatgggtaagatcatgaactctgaagctcaatggctcagattcaaatctcagctcagtcacttattagatctttgaacttagacaagctgcttaacatctttgtgctttagttttaaatcccataacatagtttgaattaaaagtattaaaaaggtactttcattatagggttaacaataccaagtacttagaaaacattaacatacagagcacttagaaaataccaactgcacagtccatttttgcttttgtgatttgtactgctaatttcttcatttttttccttatgacaaatttctttttttaatttttgtttttctttacatcttcattaaaaaatgggatacatgaacagaacatgcagatttgttacataggtatacatgtgccatgatggtttgctgcacctattgacctgtcctctaagttccctccccttgccctccacaccccaaaagtccctggtatgtgtgattcacctctctgtgtccatatgttctcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttatagtagaatgatatatattctgttgggtatataccaagtaatgtgattgctgggtcaaatggtatttctggttctagatccttgaggaatcaccacactgtcttccacaacggttgaactaatttacattcccaccaacagtgtaaaagtgttcctttttctctgcagcctcaccagcatctgttgtttcttgactttttaataattgccattctgactggcatgagatggtatctcattgtggttttcatttgcatctctctgatgatcggtcatgttgagctttttttcatatgtttgttggccatgtaaatgtcttcttttgagaagtgtctgttcatatcctttgcccatgtttgatggggttgtttgtttcttataaatatgtttaagttccttttaaattaagaatattagacctttgtcagatgggtagttgtaaaaattttctgtcattctgtaggttgcctgttcgctctgatgatagtttcttttgctgtgcagaagtgctttagtttgattagatcccatttgtaaattctggcttttgtttcaattgcttttgccattttcatcatgaagtctttgcccatgcctatgtactgaatggtactgcctaggttttcttctagggtttttaatggttttgggttttatatttaagtctttaattcatcttgaattaatttttgtttaatgtgtaaggaaggggtttactttcagttgtttgcacatggctagccagttttcccagcaccatttgttgaataggagatcctttccccagcgcttcgatttgtcagttttgtcaaagatcagatgattatagatgtgtggtgttatttttgaggtctctgttctgctccatttgtctatatgtctgttttcataccagtaccatgctgttttggttactgtcgccttgtagtgtagtttgaagtcaggtagcgtgatgcctccagctttgttctttttgcttaggattgttttgtctatatggggtcttctttgattccatatgaaatttaaagtagttttttttctaattctgtgtagaatgtcaatggtagtttgatgggaatagcattgaatctataaattactttgggcagtgtggccattttcgtgatatttattctttgtatccatgaggatgggatttttttttttcatttgtttatgtccttttttatttccttgagcagtggtttgtagttctccttgaagaggtcctttgcatcccttgttagctgtattcctaggtatttgattctctttgtagcaattgtgaatgggagttcatttatgatttggctctctgctggtctattgctggtgtaaaggaatgcttgtgatttttgcacattgattttgtatcctgagacattgctaaaattgcttatcagttcaaggagttttggggcttagacaacggggttttctaaatataaaatcatgtcatctgcaaacagacaatttgacttcctctcttcctatatgaataccctttatttttttcttttgcctgatggccctggccagaacttccaatactatgttgaataggagtggtgagagagggcatccttgtcttgtactagtttgccaagggaatgcttccagcttttgccaattcaatatgatattggctgtgggtttatcataaatagctcttattattttgagatgtgttccatcaataactagttaattgacagtttttaacatgaaggaatgatgaattttatcaaaggccttttctgcatctattgagataatcatgtggattttgtctttggttctgtttatgtgatgaattacatttattgatctgaatatgttgaatcagccttgaatcccagagatgaagctgacttgttcatggtggataagttttttgatgtgctgctggatttggtctgccagtattttattgaggatttttgcatcaatgttcatcagtgatgttggcctgaatgttcctttttttgtgtgtctcttcctggttttggtatcaggatgatgctggcttcacaaaattatttagggacgagtcccttcttttcaattgtgtggaatagttttagaaggaatggtatcagctcctctttgtacttctggtagaattcggctgtcaatccatctggtcctgggctttattggctggtagactattaattactgcctcaatttcagaatttgttattgctctattcagggattcaacttcttctggatttagtattgggagggtgtatgtgtccaagaatatgtccatttcttctagattttctagtttatttgcatagaggtgtttatagtattctttgatggtagtttgcatttctgtggggtcagtggtgatgtcccctttatcattttttattgtgtctatttgatacttctctcttttcttctttatcagtctagctagtcatctatctattttgttaattttttcaaaaaaaaaaaaccagctcctggattcatttatttttttggagggtttttcatatctctgtctccttcaattctgctctgattttagttgtttctcttgtcttctgctagctcttggattagtttgctcttgcctctctggttcttttaattgtgatgttagcatgtgaatttgagatctttctagctttctgatgtgggcatttagtgctataaatttccctcttaacactgctttagctgtgtcccacagactctgatacattgtgtctttgttctcattggtttcaaacttcttaatttctgccttaatttcattatttacctaggagtcattcaggagcaagtttatcaatttccatgtagttgtgtggttttgcgtgagtttcttaatcctgagttctaatttgattgcattgtggtctgagagacggtttgttataatttacggttttttgtatttgctgaggagtgttttacttcaaattatgtggtgggttttagaataagggtgatgtggtgctgagaagaatgtatattctgttgatttggggtggagagttctgtagatgtctattaggtctgcttggtccagagctgggttcaagttctgaatatctttgttaattttctgtctcattgatctgtctaatattgacagtgggttgttaaagtctcccactattattgtgtgggagtctcagtgtctttgtatgtgtctctaagaacttgttttatgaatctgggtgctcctgtattggatgcatatatatttagaatagttaactcttctggttgaattgttccctttaccactatgtaatgcccttctttgtcttttctgatctttgttggttttaagtttgttttgtcagagactaggattgcaatccctgctttgttttgctttccatttgcttggtaaattttcctccatccctttattttgaatctatgtgtgtctttgcatgtgagatgggtctcctgaatacagcacacagatgagtcttgtctccttatctgatttgccagtctgtgacttttaatttggctactcagtgcatttacatttaaggttagtattgttatgtgtgaatttgatcctgtcatcatgatgctgtttggtcattttgctcattagttggtgaagtttcttcatcatgtcattggtctttatattttggtgtgtttttgcatgactggttctggtttttcctttccatatttagtgctttttttcgggagatcttgcaaggcaggcctggtggtaatgaaatctctcagcatttgcttgtctggaaaggattttatttctccttcacttgtgaagcttagtttgacaggatatgaaattctgggctgaaaattcttttctttaagaatattgaatattggcctccactctcttctggcttgtagagtttcttctgagaggtccaccgttagtctgatgggtttccctttgtaggtgacctggcctttctctctggctgccctgagcattttttccttcatttcagccttagagaatctgatgattatgtgtcttagggttaatcttctcatggagtatcttagtggtgtactctgtatttccttaatttgcatgttggcctgtcttgctaggtttgggaagttctcctggataatatccggaagtgtgtttttcagcttgtttccattctacccatctccttcaggtactccaaccagttgcaggttcagtctttttatgaagtcccgtatttcttgaaggctttgttcattcctttgcattcttttttctctagtcttgtctgcacactgtatttcagcaaagtggtcttcaaaatctcatgtcctttcttccacttggtagctttggctactgatacttgtgtatgcttcatgaagttctcctgctgtgtttttcagctccatcaggtcatttatattcctctctgaaatggttattctagttagcagctcctgtgaccttttatcaaggttcttagcttccttgcattgggttagaacattctcctttaggtcagcatagttttttattacccatcctctgaagcctactcctgtcaattcatctgcctcatcctccatccagttctgcgcccttggtggagagacattgtgatcactgggaggagaggggtttttagcattttttttgttgattctttctcatcttcataaatttgtcttccttctatctttgaggctgctgacacttggatggggttttttgtgggagattttgttgttgatgctgttgttgttgctttcttttctttcttttttttttttctttcaatggtcaggtctaccttctgtagggctgctgcagtttgctgggggtccacttcagtccctattcatctggttcacgcctatgcctggagatgtcactcaaggaggctggagaacagccaagatgggtgcctgctccttcttgtgggatctcagacctcaaaggtcaccaacctgttggcagtaggatcactcctatatagggtgtctgacaagccctcttggagggtctcacccagttgggtggcacggggaataggacccatctaataaagcactttgtcccttggtggaggggatgtgcttcactagggggaaaccgacttgtctgggctgcctggattcctcagaactaccaggaggagacgctaagtctgctggtctgcagagaccatggccacccctccccctaggggctcaggcccagggagatctggattctgtccctgagcctctggctggagttattggagttcctgcagggaagccccacccaaggaggaatgatgggtcagggtcaggcctgaaaaggcactcagggtcaggcctgaagaggcattgattctgccacagtgggtgtgttgggctgtgggggacgtgtcttgggaccaagccatccagcctccctggctccagcaggggagaaagcacagcctggagctacagatatgaatgttgcctctcccccacccagggagcttagcgtgttaggcagttgtgattcccagtgctggctgctgcccctcttctaaggagctcaaatggcttaggaagcaggcagctgcagctgtggggctggccgcccctccaccaggagctcggtaggcttaagcagattccagctgaaaggctgttgagaatctgtggggcttcggggttgtgatgctagacccagtggctggagtttgtgagtggggtcttccaatccatgggtttcacagttctgtggaaaaagctgggtagcacattcactcaccgcctcccttggctggggggaagggtctcccctgccccgtgcggctctcaggtggaccactgcaccacactgttcttccctcctctccgcggatcatgccagcctcctagtcagttcttctaagagaaacctggataccttggttgccagggaaggattcacacacttactatagttcttttccatgggagcctccgaacacagctgtttctagttcgctatcttggtcctgctccctgcctccgcctcccccagcccccaccgccccactgccttcatttcttcatctgcttgtctcatttctgttgcttgcttggtctatgttggtatttatgtgtgagccgcctctatgcaaaggcattggtctcagccttggttcttgatttattctctcccctccttccgatatatacaaaggtttgcagaaaggcagtgtatgtattacaaccagttctcattgaaacacgagattaattatatacctctaaaggctacgctttgcaatacagatctccagcctcaggttaggtctccgctgatctgccaactgctcagatatgcctaaattctgcctcttttgttactactgcctgactatccggggtcttccatgtgacctctgggctacagccaagaagggaatcagagacccatggctggtgggtaatatgacatggacatttaggctttgaccccagaagccctaagcaaccttttcatgtgacccagttttacagttcctgcaggatcccagagctgacactgaaatgaacctctggctatctgagtggactgagcaagtgacacagatgttctgccaatttccctaaacaagtaacagggataaaggacaataaccttagctcagaagaggccccaggagcaaggaagcctgggagtaactgctgctggctggccttgactgctgccaagggcatgcacggtgatatagcagggagtagaagtcacaggtatctgctaattttctacaaagccatatcagtaacctcatacttcttaccttctgctgagacaccttctccttattactatgcagaagaccggaagctttaacctaaagggaggttaaacttctaatcaaatatacatggtgaacaatgagaagtgaaaattccttcttctcttctcgcttgtcccctttcttgtgtagggatgcagtaagtgctgggaactgccactctgaaccattagacctacggggcttcatgttatgttagtacttcccatacatgctttctctctttaggcctcccaataatactattaggtagattgaaatgcccccccaggaattttctgtggatttcctacctgcaggtggccatagaccatacaggctatagaccatacactatggttatgaaaaatgaaatggagcatggctatgaaaccatttttagaatttatatcgtgcttaacaaaggtaatggggactgttcatgactgtaggcaaagggagggacctagtcctgtgggagagaccactgtagcatgaaaagtgggatatactgataactaggagggcgtgggaggaaagggcattgagaatccagtgggagggtttttccttggcaccaaataggagctgcttttttccccctccagaaatagtggcaaattaatgagggaaggggagaagttgaagatgcaaagatgaagatgcagtcatagtgaaaggtctctttctaacaaattaggaaataaggtaatttgttcaagcagagaggcaggagaaatgggagttggggacattaaaacaccaaccatgagaaatgtgattagcaataagccaaaaatgaatgaaatcaacttgattaatattattagtaacactctctgagcacatactctgccaggctgtatgcactaatcactttatgtgctttacctcatttaattctcctaaagagaaagaaaatattgttatccccatttttcagataagatgaattaggctcaatgttttgttcaaggttgtacaaataataattgatggaactgagccgcaaacacaggtctccaaagagagaatcgttttgtcatagtgccttcagggaaacacggatattactcagctgaacagggtaagacaacaatggctgctgacatggattagggactagcagactggataccgcagatgaaggagtcgagtggttttagtggatagatttctcaggcaaggtaattaagcagatgaaggcaaacagaggaaaagattggggcacgaagatgtgaagaggtttttagcttcttctaagagttcaagtgttatgagagtagaaatgatacaactttttaaagcagaatcccagctgacctatgatgggaacataatgtgagggaggaataagtgactgttttcttgggcatggggaatttggagctgtctgttactgcagcacaccatagtgtgaccccgtgtgtgattttctgtgtgaccctatgtgtgacaactatttgtgattttgacatgtgacagaattatccaggcttcatgttcaaatgcaatggcccttgccccatctccaaatgtactgatttggaacctggactgaggctggaacacgacatttttaataagttctttaggtataccatacctaccacatttcgaggactagtgaggcacccaacgttgattaattggaggcacctaagatacatttgtgagactggaaacaaggcatagtgcaaccatgacttgccaaaaaaattggtagctttcttctctggcctgaaacaccccgtgccagggtataaatcttggcaagatttcagctactatgggccctcgtgcagggcacagaagtcctatttcaagaggttattaaagtatattctttcatctaagaaggtacatttttcaaaaattgtcaggatatgcagtattctaatattgtatcaaatggacacctgagtaacatgacctgacatgttaattcatgtcaaagttttattatgtctagaattatggtgagattcttgattaacaattcaaggtaatattggttggcaaatctttctattattggtgtaggaataagggctgattctgtctataatcaaaataactatgtttcattacactgcaatttaaagtaggtttatataattcaaaattctcagcattttatatgaaatgtacataaaaatattaattatgtgagcctcctttcctcctcacaaggatgacactatttaagttatttcaacaaaatgctaattattatgaatacattttaaattttacggaacttgaaaaatactttaatagttatctcaacaatggtacggggtaaaaggtgaagtttataaagaagcagttttctcatagtaaacctgatcacaaattggtaaaaacaaatgataaaaagtgaggtgaaatgatttgcaaaaagaagtactacactgccatcttctgttcaaataagtcatatgcttcaattgctatctgatcttaatgtgcattgtacttgggagtggaggggcggagaaaagagaaacttgtgaaaaactgagattatccgactccttctcaggtattctggttctgtggaatggagatggaattcaggaatctgcctttgtaggaagcactccaatcgagcctatataggtgattccctaaacataccttaagaattactcaaatatatcttggccattgtgaggtatgatgcactctttaaacatgccaggcaacatacagttccatcactgacccatgcaaacagatggttagatttcataatttttaatgtgattttgtttatggctatgtagacagttgtgtatgctagaataattctttatctccaggtttcaactgtggcattctctaatcaaatttgcattgcataaagtcatctttcactcttagattgttttcgataaggaatatgcatttttaaaagaattgggtttctatcatttctattgttttccttctcatcatgtactcactttttttctgataggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataaaagcacacaaaacacatatcacaagtgaattaagatagtattagccttgactgctctgtatttggcttattactctgtagtaagaactcctgtagaacagagataataatatcctcttcacagggttgtatgaaccaatttaggtaagtcccttagaacagtgcctgacacatagcatatgctcaaatgttagctgttattaatatttgattaacaaaattcctgaccaattttatttatattactagtttaattcacttgcttccaaaggcaagatgcccacagaatagtttctggttttatttatccacattgtatctatctggagggctttgtttctcagtgtgatacagtctgtcctcttctttgggaaatctatttgggctgataaacttatctatcatgagaaactcttttggttccatttggagtgaatttcacaaaagtgctttctccagaagaaacattatgaaaatttttgaaaaggatcctaacaatcacatttgcaggttattgaaaactaatcaatcttctatgattaacagatcctgatacagctccagtgatccatggggtggacgttataaacagtacattagttaaagttacctggtcaacagttccaaaggacagagtacatggacgtctgaaaggctatcaggtttttatcatcatggtttttcctcttcttgttgaattggtatctttcctgagaataaagaagaattgatttcagaagaagtcaaagagaatctgcgaccacaatggatatactaaaagattttggttttcattgcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggaggtgagaggataatgatgtagagtcatgtcaaaaatggaggtgatccatggccatattaaacattcttccttatggccaggcacagtggctcatgcctgtaaatcccagcactttgggaggccaaggcagatggatcacttgaagtcaggagttccaaaccagcttggccaacatgatgaaatcctgtctctatcaaaaatacaaaaattagccagatgtagtagtgcatgcctgtagtcccagctactcgggaggctgaggcaggagaatcacttgaacccgggaggcggaggttgcaatgagccaagattgggctactgcattccatctagcctgggccacgtgagactctgtctcaaaaaaataaataaataaacattattccttattagtagttaattaatatttacttcagatgagtttgcttgtcaatttctataaaatttataatataataaggcttttttgaatttttctaattgatgtgagtttatttttggtcttgtgttttctagtacctgaacagccaacttttctaaaggtcatcaaagttgataaagacactgccactttatcttggggactacctaagaaattaaatggaaacttaactggctatcttttgcaatatcagataagtaagtagaaatttgaattggagttaacttgttaatgtttcattttttggttgaatattctctgtgctatgttgggagtctaatgatcacttaaggccatggtttgtaagctgccgttcttccttgtagcccaggggtctgtaaactggcttgcaggccaaattcagcctgctgcctgtttttaggaataaagttttatgacgacatggccatgtccacttatttatatatgtctacagctactttctccctggagtggcaaagttgagtcatctcaatggagactacacagcctacaaaggctaaatgtttaccgtctggccctttaatgaaaggtttgcttacctgttttagaaaaaaagcagtgtgctgatgggtacacaaaacacgtgtttaatgtttatatataagatgtttggagaagtaggaaacatgtgaaagagttattgagtgatgtgatggagattcaaagcataggtaccttccacgctacctcttctgcctcagatatatgctcccagactcaatcctaaatatgcttgtgtttatccaatgtctatgggttgctcactgtttcatggagatgatattgcaaggactaaataattgtctttggatcatgactcagaatgggctctgcccagatgctgctgtgcgactagagtaacgtgaatgtgtttagatgagatcaggtcgtttttaatagcagcgcgttccctctgaaacagtcgtcaagtttaagcatcatctcaaaatggaaattcggggattgacattatagaaaattttatcaacaacccatcatgaaaattttaggctttcaagacatcaattcccaaaacaccagaaatacagagacccagcacacactgcttactagtcaacttgatcatagtcctgttgtgctactttcacatcagctcaagacttccagcaatccaggtcacgtatttgctttagtttctgatggtttctgctgaaattagcacgtatgtttaaatacatacaggcataatcccaacggaagtagactttagcacttttacgtgcttgctaagtagcaggatcaatactaagtgtatctctttgcattgtgccattaaaataagaaatctattagaaatgtactatcactattttatgaatgagggaattgatgtacatcagagtcaagtagtaaaataagtgttaagtgggaggccgaggctggtggatcacgaggtcaggagatcgagaccatcctggctaacacggtgaaaccccgtctctattaaaaatacaaaaaattatccaggcgtggtggtgggcccctgtagtcccagctactcgggcggctgaggcaggagaatggcgtgaacccgggaggcagagcttgcggtgagctgagatggagccactgcactccagcctgggcgacagagccagactccgtctcaaaaaaaaaaaaaaagtgttaagaatgcaaagcaagatcagtccaattctagatgttgagctcttaaccttatattagtcgatgaactggttttcaaaaaaattgtaagaactgcagaaatattttaagattcttttaaatgtcaatttgtttggtaaagatataacttctccttatcctaacaataggaaactcaactaattaaattcccaccttcatattgatccgtatgtgacatttacgtttatttaaaaacaagttcttagaatatagaagttgaaatattaacaattgtaatgattattgaactgcttgatatgtgtattttaaaataaaataatatataattattttgctttctattaatattaattgatcaagacattttaggtagtttacctttttcttattgcttttagatattttaaattgttgcaatttatatgtatgagagctctatgtatactctcctgaattcttatattgattgtagtcgtttttcaattgactttgtggtcattcacaattatgtgttcaaaaaatctaaaaaagtgatgatttcacctccttctttccaatgtttgaatgcctagtttgtttgttttttcttttcattgatttgaattgcatttttatggaccaaggaaggcatttttatgtcaataataaatgcatttttttaacctctatggtatcttggactgggagtcaagaggatttattctacattccttcttgccactaacagctgcactatcttgggtgtatttcatctcttggactattgttacagtaatcttataatactccatactcttacacaaatctcatgtctttgctgggttccaaattctttgaaagaagctgtctatctgattcagctttttacagtgagcactttacatagtacttagtacacagtagatattcttaaatatttaatatattccttcatttattgattctatgtatactgagtagctatttggtgccacatgttaaactagaaaccatagaagacacaaataaattatcatctcaattattcttccaaaaggaaattataatacttaagtcaaagatacaatgaaaatatagcaatggggaaaattcattattattaatgcgtattatgaagctggagcagctggctccaatatagcacagggattaaagacgtttctctggggtcaaaaggccatggtttggattcaaatcccagtctgcaaatttagagacccaagatgggagcaaagggcttattcttgcgagacctcagttttgtcatatatgatatagtcatagtagttgtatgtacctcataggattaaatgagttgatggttatgaatcattaatgtatctttacgtaccacaagcataaggagaaatgaaaataatgaagaatgcaacttgaatggttaaatacatttgagctgttgttcatgtttatttttttagtaaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaagtacatgaggcttctctttttaatagaggctttaaaaagagactgcatctttttaaacagctgcactgaaaggaaagcaccgtgccagtcattgtaaattagaaatgattgtgatcccactctgtctgaccttctgttttccactgacatagaggcagaatttattaatctgtttggaaagttcacactgactcaatttatggatttctgcgcaataccaatcaaattatagcttagtgtatacaaggtcaggaactataattttacttaattaaagtagcaggacataaggtcacaaagctattcaaaaggttagtaaaggtacgtttttcttttagaaatgtttccatacagaaaaatatttggctcttccattggtagacattacagatctaatacatctcactttcatgccttcactctatatacattgattcatatgtcaattttgttttactgtctgatgatggatgccaagcaactgtctgggaaatggcttataaatgtatggtttcacttgtaacacaattatcctaattcaattacacttttctgtttttttctacctttaaccatttcctttcccaaattgcatctccagttatgattttagtgaggttcttgctaagctttctatgatagcaacaggacctttgcagagaaatcaggtcagaggaactgatgtacacacgaagtgaaacagagagagatttatgtagggcttaggctgttcaggcatggaaggatattggagaaagaaaagaaggatgtagaagatggcagaaagggaaatagagttgtttatttatcatgtattaagtgtggtgcaaaagtaattgtggcccttccattaaaagtagtaatggcaaaggccgcacttacttttgcaccaatctaatactatgtgtcagactgtgttctggatgcttttccaagttgtagattagaaaaacggtagaatcaatgaaagaaacatcacagaggggaaaaatagtagagaaaatgcagttgcctattatttattgaagatgtatattaaaatatattcaagcttgtgagtgactgtaaatcaccgtgtttgtgtgtgaatggttatgctctgacctttaatattggtttgtttttacatcttattgtgcctactatatctaactaataacaagcttacgtttttctcagattccttaaacatttaaaagccctttatgtgggaaaattgtataatccaaataattacttccctaaaactcacaaagtattcccagggatgaattgaacaccaagtgaaatgaagaactaatttcactgactttacctactcataaaagttagacttaaagatggggattggaaacttcccagtaactaaaaggttcttatgtctgaagcattggaactgacatcaagtgtccaatacaaagagaagtcagagtggtagtagtccaaacatgcaactgccatatttttaaaaacagaatttaaggcatggagttggttgctattttgatataaccaagaccataatgtgcatgtgaaatgctgatcccattcttaccaattggaagcacatgagaaaaaatattcacagaattgcctgacaagtgttacacattctagtatatatgttgcgaaatttgggcttggttgcattcgtgcttgagaaattgtttttggaggatgaaagtgctgttcatgtgattttacaggtgatgtggcatcttttctttaaactaaaaatgtaactaatgtgctgcatgtcttaaagaacatttcttcactgtcgtatgtgtcaggaatttaaaaatgtttcttactggtgtgtttgtgctctttttcaggaatccacattttcagtattccagctaactgcccccttcccgagttgacactgatttctattctataggcatgtcttgctataagtacagggaaaaaaattacaatctctttttctactagagttcaacatgatctttgaaaaaaatatatatttccaatgaggagagatacatcttgttatcagtcagcactctaaaaatgatcacttgtgcaaataggaacctactgctatgcatctttcttcttgctctgcctatatagctcatttcaaggtcatttggcatttgttcaaaaaataggatttgattgacaagtatttttctctgattgttttcactctgatttccaagtaaatcatattccataatctaagaggggaaaagatggagttaatcagaaatattatttttgtgtcattagcggtttgaataaatcacttgctttactctatttttcaaaagcttgcactacttaatgttatactaatatctctgtttttcaaggtcaaaattaattgcactctgtttcaatgacgcttaatcttgaaggctttgctcatataattggccttatttctctcatggtgtcatttttaataaaacctttttgttatttagtaactatataattaatttttattttatagtgaaaatacataatgaaatattgatctgtaacatatacccacttaaaatagcatttcataaccccttgtagtctcagtaagaaacatattttatatcattgttaacattttctgggttatgtttattatattgagttgattcccagcaaagctgtggatcacatgcaaaaatatttaagatatttggtggtaagacaagaagttaacatatttttgttcaacttgattcattttatcttctactatgagattctactattaacatattgacatattaatattttttgaaaagtattaacttctcacaccactttcaaaatgtcagtaaaaccattccattggtatgtacctgcaagcctgcatttcacgtagtttggacttctataaatttcaaatatttaatatatgaccatattttaatgctatttcatcagtgtttatggagaagaccaaagcaaaaaaaagcaatatatagttagttacgattataaggttatgtgctgtcaattataagtcaaaaggccatattcagtttcgcattaggtttgcgaaaatccaaattgcacaaaattatattgtataatttttttaagtctgtggttttgaaccattcatgtgaccaggcagatttacagtaccatttcatcttaaatggccatgcattgagttcatttcatttactcaatttcattatattaaaaaagaaagttgaaatgttgattttcttgatctcctggtaattcaaaaactatctgagaaaatatggtataagtgactttcttattcacctctaacaacaatatttttttatgtcctgtttttccatgattacaattcacatgatttaactgtgtacatttcttaggtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagaggtgagaaatgagattatatttggggaagtcttagtcaatctatgtcctgtagaatacttagtgttgcctgtgtcctatattaaacataaaaacactgagtgtattaattatgaaaatcgtaatttcaatttgttttgacatatttttaaattatcaaaatgaaaaatgtttcacagtagtccaccatcctttattttgtttttactagagttgttgcctaaaaatatctcctgctaattaacatatcttaataacacaaactaaaaagaaaaagcaaaacaaaacaaaaaccaccggtctccatggtcatctgcttctaaccaaggcagcttgcgcttttgtttgctccttgctgcttctgagtttaacttcatctgccttcattatccttctttggtttttcatcctcggaatcaaacacaactcgaagaagtccctttttaaataaagaaggaaagatttaccagtattctcccattaacatgtccttcaaattgcattccttctggggtcattaaaaaaactgatactatttggtatgtttaaaaatgatgtctaattttccccaatgttacagaatacaaaagactgtttctagtttacaatgctgtgacttctctttctaccacagaatatgctggtttatatgatgacatctccactcaaggctggtttattggactgatgtgtgcgattgctcttctcacactactattattaactgtttgctttgtgaagaggaatagaggtggaaagtactcaggtaaaattgtttcttaatgtgattttcaacttattaaaaagcattttctgggaagcattcttcagagacaactttttttaaaaatacacattcaagtcaaatttatattagcaagttagatgtacaatgcactgacaggaaaaacgtattgctaaattaaccaaagaaaatatgtatgttctagtttctagcacttaaaatgggctctaactgccgggcgcagtggctcacgcctgtaattccagcagtttgggaggccgaggtgggcggatcatgaggtcaggagatcgagaccatcctggccaacatgatgaaaccccgtctctactaaaaatacaaaaattagccgggcatggtggcagctgcctgtaatcccagctactcggaaggctgagacaggagaatcacttgaacccgggaggtggagtttgcagtgagctgagatcatgccactgtacttcagcttgggcgacaagagcaaaaactccatctcaaaaaaataaaaaataaaaaataggctctaacaaggttgataacacttccaagcttctattgtctatctgtaaaatatcagcgtcgttgagagacatatcactaggtcacatatatgctttagtgttttaagaagtgacccatgtatagcacgcctctctctatgcatgacatacatgactcatatttttcgcactagtgcattctaatattactggctccactggtcaattttgttggtgttaatcattactaggaatgcatttcttattaccatggcatgtagtagacacactgcctcttgaattaatgatacataagatatacatgaaaaccatcatagttggtaatatgacgtttgcctttaatttcattcaactcccgaatttgttttgtctttttcagatatacatattgtatcaagatgatgattattactagtattgcttagtattcatgatgcttttataaagggacaaagatttaggttacactgctatttgtttcatgatgttcagatatatgagaagttcattactggcttatgatttatctagcaaatatttattgggaacccgtcatctacatagaaacattgagagcataatttctaggtttttgtaaaatgacatgcataatttatggagttatgcgtttcacttttttctctgaagactgaatgattatgaattaagttcacaatgactaataaatgttctgagtaattaattggaaacgttaaagagttatagcattctccttatccccaacagataatcatttgtgtattgtggtgctatccagattccaaagatgtttcttcaaatcatgccctaaaaagaaaaaaaaaattagcatttcatattgtagagcaactaagagaatctactaggtctctgcatgtagtcgtaaaatgttccaggaagaacaatttgtatttgagggctttttttttttttttaagtaaagggaacaagagctttttggtcttatattccactaataagagaaatcagccaggcatagtggtggctgcctgaaatcctaactactcgggaggctgaggcaggagaatcccttgaacctgggaggcagaggttgcagtgagccgagatcacgcctctgcactccagcctgggcgacagagtgagactgtctcaaaaaaagtaataataaaataaaatgtcagtggagacctgaatattcagattgttgcaacaattttgagtaagagtgatgtataacaaccaaatgactgcctttttttttttttttttttgagacaaggtcttgttctgttgcccaggctggagtgcagtggttctatctcatctctttgcaacttctgcctcccaggctcaggtgatcctccaacctcagctcctcgtgtagctgggactacaggtgtatgctaccatgcctggctaatttctgtgtttttaatagagacagggtcttgctttgttgcccaggctggtttcaaactcctgatataaagtgttctgcccaccttggcctcccaaagtgccgggattacaggcatgagccaccacatccagccttgattgactttttaaattcaatttagtttaatgacacagatctaataggtgtctatgacatcttcaaaaagttcagatagtaaaataaatatttagtaatttggtcttcactgagaaatcaaactcagttgggctcttccaataagacttctcgttcacataaaattgagtagtcacgtgaaaatatgcaacatgctgcaggtgtgacgacaagtagaaccccccaaaatcccctctcttttttgtttaaacaaagaagcaactgatgggctgtaggtatagccagaaaaaaatattgcctcactggtatcaaaacatttgagcaatgctgttcttactgactattaactattccacagcactggtaaaatgtcttttaaatggtcactgtattacttttcccactttttttctcttttttagttaaagaaaaggaagatttgcatccagacccagaaattcagtcagtaaaagatgaaacctttggtgaatacaggtaaacataaggttctgttgtaaaataaaacacatattcatcatgttgaaagcttaagtgaacaaaaaggtgtttattcttaataaaaaggttacataactacaatgtaatgaccctataaagaatactttgtacaaatagggcccacttaagtgctagcaaccaaatttctgtgtgtgtgatgagggtgtataaataattaccgtctaggcagaaatgtcaggtaggacacttttcttgaagctctgtgcctaacacaaagaatatctatttggggtagctaaaacatctatagcatggccattatgaactcgggttcaatccaatttgcatccacacacgcatatctgtatacctacagcgttgcacctgcaaaggtaagtaagttacaaaccctgtcctctagatgaacctgatcagcagagaaaaatatcctatatatgcaaatgactgtaatgaattaaatagaataaaagagcacaaaagagagtaactgtttctgcccaggtaggattttggaaaaagaatcatccataagagataagctaagccttaaaggataaaaagtattgtgttactgttaaccactggacagaggatgaccaaatgagtgagggtgtgtcgggcaagggaggaatggcaagaagtctactctgagctaggtaggaatctttcggggacgtgttaaactgtctcattctccttttatctttctccaccttcccctttctgctactctctcaacttcttagttcttttttgttgtaatgtcatcatttttctcaggtctcctgtatatttcagccaacagacatattgtaagttccaggtttgtattgattttagcacatgggaaaccagagtttatattaaagaagaaatctgattgatcctgattctctcatctctggattcattactctagcaagggatatggagtattttcattagctaattggtagacatttgggcttacctgtacctccattttgtggtatacttatttttctgtattctacttagtcaataccctttttatatttttatatttcttaataaatgactttaaattctttccagaataaagaacaataaagagaaagaaagaaagagagaaaaagaaaaaggaagaaagaattttggaacttcacgaattgtgatcattactattgtattagttagcagttgcctcataacaataaccaccaatactcaacagcttaaaacaataaacatttattatttcaatgtcctcataattcaggaatccagacatggcttagatgggtacttctggctcaggacctctcatgaggttgcagcaaggttttgaccagggctatggtttcatctaaagtttcagccaaagcacaaatcattcctaggccattcgtgtggctgttggcaggatatagttccatacaggctgttgaactaagggcttctgttcttcacaggccagaggtcattcctaactccataccacgtagatatctccatggggccattcacaacatggcagctggcttccttcagaatgtgtgagccagggagcaagagagagcacccaagttggaagccacagtccttttgtaacctaatattggaagtgatatcccatcacttttgttgtattctataggaacaaatcattaagtttagctcacaactcaaaggaagaggattatacaagatacaaattccatgaggcaatgatcattaaggacctgcaacaacttttcaaaagctgaggcaggagaatttcttgaactcaggaggcggaggttgcagtaagctgagattgtgccactgcactccagcctgggcaacatagcgagactccatctcaacaacaaaacaaaaacacaaacaaacaaacaagcaaaaaaaaattttgaaagacaatattagctcaattttacaggcaagaaaacaaaaacaatgccttgtctaaaaacccatttccccacaccctgctgctcctttataaagatagctaacatcttcctgtgcattatttcctatgacatccctttatagtagctgatgtgttttccaacctctttcccccaaactacatatttatcaggataattgtctactttccacattatcccaggagacacttttataagatgctgtgcccttgcataagtcctcattcttctagcttctgataatcatcccttttgttatttttctttattctttgttcctgattcctcagccgatgcctcattgtttttcttgatttgttcttgtaactgcaatatcctaattcaagagccaattatcgtatcagtcaggggagcctgtgttatgctgctgtcaaaacaactccaaaagcattttctttctcaagttatgtgtcccacagagattgcccttttcatcttaatcacttaggagcactggctggtggacgagcatccaggctccccacagcagggaaaatagaatgtaataaactgagcactggctttaaatctttggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcatttcactaatggatttgcttctgttcatgaataaaacacctaccataaatatagtatacttatttatgttcttaaaataccagccatttctttctgtcttaaaatgtaacaaacttgaattgttaactatattaaagaaagttatttggtttcaaaaacagaatgtgattgatttttaaaaaagaacattttatcaggatataagagaatcaaaaggatcagaagtaaaggcagaagatcaagacttggaggccaggagctccaaaagttcatgacagcaagggaaattgcatttgttctctgtctgagtccattagggctactataacaaaataccataagctgggtggcttataaaagaacagaaacttaattcccacagttcaggattctgagaagcctaagagcaaagtgccagcattttcaatgtctggtgaacgctcactttctgggtgacagatggcaccttctctttgtgtcctcacatcgtgaaaggggtagggcagctctctggggcctcttctctaagggcactaatatcattcactagggttccacccttatggcctaatcacttcccaaagactccacctctaacaccctcacattggttatcaggttttaacataggaagcttgggaggacacagatattcagaccatagcagccactgtggacatcaacaggttgaatcccacatgtcctacagaagctaagctgctcaattttaaagagaagcacaaatgttgtgaataatgaaaaattgtttggtggaaattgcttatgactttgtagacatgtgtttacagacttcgtaaacttggtaaacatttgtggtagtatcatgtgggctttactatctgtcttcaatgctaacacaaatgtcctgaaaattataaaatcttttatcacttatgactgtgttgctttacatgaatattaatattagattttgttgagctatttttgtttgtttgttttctagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaatgtttgtattctgttctatatagttaagaagaatcagaatttacatattaatcttaactacttcagttgcctctgatcctggaatatctataaatgaagtataatttaataaagtaaaaataagataaataaaatattttgatttcaattactttataaatatacaatatcatcatctataaaaaagaatattacaataaaatttatatttataataaatataaatttaaggtgaatgtatatttatctggtcatttttaataaaaatgtagaaatgtcacttttcaagaaaatgtccgatatgctatattttcaatgaggctagtagataattttgatatggtcttttagaattgggttacccactttggctcaggggacaatctattgaaaattgttatttttaaaaacggttttattgaccggacatggagactcactgaaatcgcagctctttgagaggatgaggtgggtggatcacttaatgccaggagttcaagtccagcctgtgcaacatagtgagacctcgtctaaaaaatttaaaaaaaaattatctataccaagcactttacacagaataccacatttaatcctcgaacgatattctctggtttgttaaattaggggaccgggaggttaactaacttaatgagtgtcaccagcatgggctagaactagaaattaaaccctgggatgtttgactccaaaaccctaattcattgtaccattaatagtacattttttcatgccctcactcctccaccttttcttagaaatactaaagaaaggtgagtttcaacttcatgccgacttattgatcatgcttacaaacaccttggctttaagatatgcgatcaagacatacgataggggaaaacaatcaatgctttattgtataaacagttgaatgtgtacaacctaaaaagtagtaattcaaataagccagttatttttaaatgaatgtcacacatttcattatattccactcactctattgggaaactgaaaaagaacaaaagctttttattagaagtggcttcaaaaacaactgcgctaaacattttaaagttgatatttgtatttgctcatcaaacaccagagtctatggtaggacatctctcctcttttgctattctcatttgtttccctgtaaaatacaacacagaatttttaagccatatatctctggactcatggcatcccacttatggagaacccttatcgccaagataaatcagactttaagtcagataaacatatgtacgataacctctcaagggccttattttagtattttagcatatgttaatacaatgagggttttattatcctcacatcacttacaatgtgatgcaataatatatatatacatgagtaaagaaaggataaaatatggaaattcccacgttacctgaaagaaataatataatgcactgcaactgaaatgcataaattcttttaacaggtggaaaaaatctttcattgattggtctatttataacaaaatgaaacattaaatattttccgacgtgatcatctatataaattgttcccaaaatagttctcttgaatcgctgattctgtggaaaacattatgtttgaccaaattattttgggaatgttggcaagcataattaaatggatacatttgctgcattgaaaatccttgggagaatatggcgtcaaaacttgctggaccctggagttctttgcagactcaaccttagttcgctttcccactccaatgctttcctaaggtgtctggtccatttaagactttgattgccatgggcagacagatgacttcaagtcatttttagcccagttctctcctcagatccgaggcttttacatgtgacattttacttggcagctctctgatgtagacaatttcagactcaatgtttcaaaagtaaaagcataatttccacgtttcaaacccttttttcccccactgtgctattcagtgaatgacagcagtaatccatccaaccactcaagacaaaaacctagacattgtccttcatacttgagctttctctttcaactcctgtgctcaatccatcaaaaaattctgttgatgttttctcctaagtatctcctggatctgcccacttgtctgtactcagacctcttttatgctgagtggtctttctgtgttgactggctcccctccagtctcttatccactatgcaggcagggtgatttatgaggtgcagttctgttcgcgctgtttccttactttgaagaacaacaacaacaaatagctttccatttcttctaagataaaaacaaaaatctataattggcttccaatgtcctccatggtcagatccctacttagcttccaagtcccttaatttctggttcttttttttccctttctccattccagtcctgatgattgtattaaacaagtcttttgcatgcttcagattctgtaaggttcatctagccactgctggagtgaacagttctgcatggaccaaagctgactaactgcaagtcagcttgcaactagctgcagtgttcatgatgcacccttgcactatggcatgagatgctgtgagactgtctggtgcccattcatgctcaacctggaagcatggaagggttaacaccttgtggggcaaacatttatccaatgggagaatggagctggtcgataaatgccaaccttctctcttgtcctgtgtcccctcccttctctcttataccaaatggtcccatgggacagagcaatcattggcattcaacagtggccaactcaataacgtatcttctattggttctccctgctcccttgtctcacgctgccttcggcctcatgcctgctacctaggattgcactccctaataaatgagtagcccgtgtactgattcctgcaggctctgctgttaaggaatccagactaagatgtgtgttttatcagttccaggtattttctcattccttcctgtcctgagaaacctttaaatttcttctccttcacaaaatcactgatctgctttcaagtttaatatcatttctccagggaaaacttccataactagatgaaatcatcttattttaatgtgtcatggtgttatgtacctttgatttttagcatggaccactgctgaagttttacttttattacatggttatttgattaccatctctatttatcctattagtctaaaagttttatgagggcaggagatgcaccttcattttcactggaaataccatctgcctagcacaatgtcttgtatctgctgggcatttattaaatgtttactaaataaaagaataaaagtcacaaggagagatattcaaaataattaatacatttgagagaatgtcagtctagatgcatgaaagaagtctctatctgcaccccaaaaactgttcttaccccttgtgtttttcatcttaataaatgactccaccatccacccagtaactcaagccaaaagctttaggatcattcttgaatccactctttcctcattgtcctacaaccaacccatagtctcttacagtgctaactccaaaatacagtttaaatctattcatttttctccacagtcattgctaccatcctgggctaagccaaaggaatctttttcctgttactagccttccttcattcttgtccctttctccaacctataaaacaataccagggaaatctgtaaatataagtcagattgtattagtggtttctcagtaaatttagccacaatcccaaatgtctaaccacatggctgtatattagctagctctgcctaccttatgaccttggctcatatattcttcccccaaaagcaaagcttgtgccacgctgcccttctatgtatttccagagcccaccaaatctctttcttgcctcagggcacttgcaattgctgttccttctgcctggaatctttccccaaattttgtgtgagctcacttatcaccatttaagtctctgtttgaaggtcactacgtcagagaagacatttctaattaccaactctaaaatagccaggctctgtgatattattccttttaatttcttcatagcaatcattactacatgaatttgtattcttattttttttcttctctgttcttattacaatttaagctctatgagaatgactttgtcttgctcactgctttcatacctagaattggctccagaatataacagatgctaaatttttaggtagatgaatgaactaaagcactaaatggaaaaatacaataaatcataataagaaaaagccaaattaatcttatcaaaacctattggctcgagtttttaaaaaatactcatatatttagaatatacagttgcctccaccaaaaagccttgtatagtgcataaacacataaagctgctcacagcagaactgatcaaactgccaaaaaaaaaaaaagatttttcttttacagctgatgccaagccctttcttttttccttttagggaaagaaagtcattattaatgttttataaaacaataacatgacatgtaaatcagtaattccagttataagaatcagtacaaaaaatttctttgctaaatgtcagtatcttaaaaacaatgaagttaactgcagtacaatatgcatttgaataattataatgaattaaaatgtttataatatatgactataatttcataggaaaaatgttcatattataaaaaatgtgaattcttgcatagagtatgagaatcaactatgctttaaaataaaattttaaatttccaacactttttttgattaaacagtggataataataatagtaataataaaaagcatactgttttaataaaagatgtagttaaaatctcaaccactagatggaagtgtttcaaagtaatataaactgccttacagaaagcatcctacagtcaagatattttttcctcaaaggcagttttcaagctttagcatgtattatgtatgtattacttagtttacactccttctttcacttctaaattgtggccttattataataattattgactttctttgatgtaagtttttgtaaattatatagttttttttttcctaatttagaaggggtaagtgtttttcaaacgttaacaaagtatgataaaataatcttgttataatacttaggacttaacaaccagttttctagtttaacattttaaataccggtagaaagagagggaaataatgtctgaattatttatattacctatttctaaacaaatcgatatttcttacctttttctttaatgtataggaatacctcatttactgtgataaaatattgtctgatatagatacataaatacaatagagtactaatacctgtgaagtcatgaagataaaaatgagttcaaatatgtaaatactttagaacagtacctgtcatatgcaaaatgctaatcacacattatgacatgttaattaaacatttttataaagctgtccaactgagaaagtatagttatggtcgtgttgataattctacagtaaaggataaggctctatctgaaataagctctttatcttcccaagaaagggcaccagatgacatctgagttgacgtgtattgtaaataaagccttaatttcaaaattgagttgaactttaactttagcacataaaaattaaatacttctatgtaattggctaccacccatattaataccctcaaagcccagtgggcacccgcatcacctgaacggcttgttaagacagactggtgggccccagccccagaactgttagttttgtagatctgaggtggagcccaacactttgcgtgttaaaaaaaattgctgtcgatctaggaatcacaccttgagaaacattggcctactacggtgcatggatttgaacataatcagttaaactaaggaaaattcagaaagaatgaaaataactccaaaatataagaatgttccattaattatttgaatactctttttaaagaagtagcaaattaactttcagaatgaaaaagttatgacatacttccttcaagatttgtgaaccaaaattcacagcacagtcatgtttgccctggacattgggatagggagttacagcacacgcatggtgtatttgcatttcctgagtttgtaacatcccatggattttaatatctggcagatcaattttattttttatcccaagtaacactggtctaggaagatttgctcaacattctattgtattcaattttttaataaattgagccaacagaacaactaattttgaaaggctctaagaagccatcagcaatttccaaatagattgagtgtgagacggtaacaaaacttagcttaattctcaataaaaatatctgtggaatataaattgaagccaattttaaaattctcagtcaagggattagctgatgttcattatatctatcttttctccacaatctctatgtttacattccagacagtttgacgagactagagttatgtcttttgttgtcataatccaaataatcatcagtaaaattatttcataaatttctctgcagtggaaaatcgagattatgttttgccataattaatcaggcttagagtcagtaaatgcccataactatcctctatctgctgtcagatgtattttagtaagtgattgcaaagtccttgaactacagacacaaactttggttattggttcagttagcaataaagcatagtgtcttttcttctgtgatattttagtttttctaggtagttagggaagatactatgagattgctcattgctatagatcccatgttcatcattatctatctgagtccctttgggctcagaatattttatacagttaatagtttttcaggcttcttgagatatgttacctatctttagttattcacatgttgaaactccattcagtacactgattttcagggtactccactttatgctagagttgtgttcctaaaggctttaaataactcaaaactcacccaattcaagacttagcctgataaactaggttttatatttaccagctaaagagggtaattccacttgaaaagacatatttacaatttacacaaccagctatgagatcaaattagtatttgaatttaatttttaagatgagaatggttttgcacaaagttggagttttttatggtctatgtcacactatttcaatacaggtaaatcacatttatataaaatataaacatggtaattatacaattgtgtcataagaggttcgtggtaagccacaaagtcatagacatatgagtaaacttaagagaaagatgttgaataaattatgcaataattattgaacactagcaattattgatagaataaaagacccctttcttatgccaaactaaagaacatcctttaatgcatgaaggagcccaagcagcttgagtagaatctcacacacacacacacacacacacacacacacacacatctctttttgtttctaccattctccagacatttccatttgcaacaatgaatgatgattgggtctgcctttccccttcttttttcttcactttgcttatttttctcttcctgtttttctgccacaatgtaatatgctagacctaactattttcctaaatagctgccatttactgagaccccaagagctaccaccatgtgcagttagattgacacatacactaatgattgaactccccacaagaaatactactagctgactaagtctataaccagagtcaaaggtcatcataaagttcatttaccactgtggaaaactggaaccaatgcctggctcagacatgaatgacaacaggtaataatgtggtcatctagggataggatagcaaatggatttcaaatattgtgagaattcagattgacaaatggaatattacagactattgtcttgaagattcaaaggcagcattgataacaagtatcccaggacggctgagtgatgctgccatgggtgtagacaggggattccagggatatacaccatggagttgaaacttgaattgatgcctcatgtcacatattgggtatccttgacttaggtggtaggtagatagatgatgcctaatgcctaaacataggaatatttgtcaatgtccaggttgattgccaaatacttggagatcaacctctaatgggttaaccacagaagacatcgaatgctactgctaaaaactcagactaccaaccctaacctctataccaattagcattgtctaaatatctggtcaccgttgggtgcatgtctggagtctcacctaccctcggttcccaaaatatgggtacttttcctagaactcctaacaagcaaaatgtttactctctagaaccaatggggaggatttctttctgccaagaaagagcagagcaatgtggtgggaacagcagtggagcaagtcaggactctcagatgttggtgaggttgtggagaaaagtgaattcttatacactgttggtgagattgcacatatatagttcagcccctgtggaaagcagtttggagatttctcaaataactaaaattataattgctgtttgacccagcaatcccatactggatatataatcaaagaataataaattgttctaccaaaaagacacctgaactcatatgtttattgcagtactatttataatagcaaagacatggaataaccccaggttcttatcaatggcagattggataaagaaaatgtgtacacatacaccatggcatactacacagatgtaaaaaaaaataaaattttgtcttttgcagcaacatgggtgtagctacaggccattatcctaagcaaattaagacagaaacagaaagcccaaataccccacattctcacttataggtgtgagctaaacattgggtacacaaaacattgtgaacacaaagatgagaacaataaacacctccaaaggtggggagggaagaggtgagcaaaagttgaaaagctatctgttagacactatgttcactgcttgggaaacaggatcattaaaaaaagaagaaagacaagtgaggaaactattacagtgggaggagtaactgagaagaggagggagtactaaagtacatgatttttatggtcctgctatcaggttttggaattccagcattgtttctatgtgcattgccacataatttcccagctaaagctagcaattatgaatttctctatatttcccatcagtcgtcaacaatttgctaaaaataaagcaaactaatagtttaatttaaatttaccaaacgatatgcatacatgacatcagccgacactttccatcacatacattaccataaatttatcattctatttaaattgctatgataatagagtaggcattgatgcatatgtaagtcttctagcgttttaagaagtacagtttcttattaggggcctgtaaactacagccacagggaaagtccatcccctctgttttttaaagttttattgtcgcatagctataatcatttacatattgttgacgtttttaaccttacattattgcgtggttgtgacagaggatatggcctgtaaaaccctaaatatttattatctagtcctttacaagaaaagttttctgaccccagttctgtgctatcaatttcaataaaacagcatcagcttattgtagttcggaaatgctagaatgacttccaaggggaaataaaaggaggtctgcagtgatagaaaagtgctcatagtggtaagccataatcaatgcactgaaggaaattaaagccattgattgcagggaaaattgtaaataagcaaaatatttattaaaaacaacaacaacataactatgtttttcttttaatattaagaatagagtatatagatgtgcataaagagtttattgctttggggttctcaagtacttggctgtgggttgatgagaaaggaataactttcttttttgatctattcctatacatgaaaggaatataaattagcctataatctaaaaaaattatctaaaataaaattactcctttaaagtgatccttaaaagtgaaaacatatttgcatgacaataaaattttaaacactagttttcagtctatattattcagtggatgtgtttaattttctttacttgatgttagctagaaaaggtcggttttttgtttgtttgactttttattcagcctttcttatttgtgatgtggatgagaaggttagaggtggtctttaaaatgatgggatgtctgctaagacgtcatttatgatctaatggctctttgagttagttaacttcagttagggttgtcagcggggaaatttgattgggatattatgtttgatttctccttgtagttcacctgaggacagaatcccaatgccttctttgtcagacactaaagcaggaagaatgtgagtcgtttcctccgggttccctgatctttcactctgatgggtctctatctcaaacttgcttttgtttccttcaacgagaaggaaaataaagctactctaacctgaagttactaagtccccaaattatacacgttcttcactacctgtaggcttcttagttttctttcaagttggttcttcccccttccttgcctcttttcccattttgagttcattttaatggttttcttatgaataaaactaaccttgctcaattcttcatttgttttttgcattttagctttcatttacaattgagtgatgcatttttgagtgagctctgaaagatttgtgcaagatttgcctcccagttttacacagcagattgtttaagtgtaggagagcttttcatgcatattattttgtagtcatcattttgcttgtatcctaaaagacgtttcagcacagtggttaagaactccgaggacagtattcaaatcctgactcagggcacttgcttgctgcacaaagttacttactttctccattcctaaatattcacatctgtaaagtgaggataataacagtacctatctcatttacctattcggaggagtacctaaggtaatagttacaaaaggcttagagcaatgcctggccaagtgtaagtatttattactactaggacttactggtaagatcatggatgcacactctggtcattatttctcccaaagtcattggagcctcttttccttactggggagagggacactcatgttgggtactgatgtgggatgggaaggcaagttccttttctaatactaagattgttaccccgttctttccactgatgtgtaaggggatacaaactggatggcttttgggatcccttcacttattaaagaggaagtttaagaagaaatgctctgctctgaaccatctcctgccagatgcctttgaatgtaatggacaccgtgatgattgaagctgctgcagccatcttgtgacaaacaggggaagtaaaaaataatcgcagacatgccagttactgtcattttggaactgaaacaacccagcaaatactgtcttgtaggcttcttgtcatgtgaggaaataacttcctatttgtttaggtcaattttagtcacaattttctcttcatgatagataaaaatatttccattgtacagaatcatctcttctacgtaacgacatctgctttttgaatgcatagatctctccaggggtgcattcaaccactctatgataaatatttgagttggcatttctgaaatacatatccaatgataaagattctcaccagtggtttctaagtctcacttcaaaataacatataatatgatattttaaaaaataaattcaagtgtttcagtaactggataagaaaatatcgcaaagaaaagtcagtgtccttctcaagggtgggtcttggaacaagtatacgtgtatccagaggttggctctactgatcaagaaatactcatgcaccaggttagtgtgggtccacctgggtgcccttgtttgcactgtaataaaatccaaatgaaatctttaaccaatttgcatatgttcctaaaacattttttcagccgggagtggtggctcacacctgtaatcccagcactttgggaggcgaggcaagcagatcacttgagctccggagtttgagattagcctgggcaacgtggcaaaaccccatctccacaaacaaagaaacaaaaaaaaaaaagcaaaaaaattagcaaggtacagtggcatgtgcctgtggtctcagctacttgggaggctgtggcaggagaattgcttgagcccaggaggcggaggttgcagtgagccgagatcacgccgttgcactacagcttgggtaacagaagtgaaactgtctcaaagaaaaaaaaatattttaaataaaacaagaaagttaacatttttttaactggtaacatttacggactacattgaacatcgcagacattaaaaaaaaagatgagatgtttattaataaggttgtaattgaagaaaaaataaacatcttctagttttccagttttcctgaagggccagaaacaagatgcaccacataaaagatatgtctgcaaattatgcataatttttcctcatctgagtaaggacctggaaaagaatcagacatattcctcaatttcttccatgggattttaataagtcctactattaattaaattttaaggagtctgcatttagaagataactgggttaaacaaagttaattacattctttaaaattatacaaataacatatgaatattatcttattacaaaaaagacaaaaaataacactttaaaaagttcttcttgggccaggcttagtggctcatacctgtaattctagcagttttggaggcctaggcgagatcacttgagccccggagtttgagaccaccctaagcaacattgcgagacctgtctctatattaaaaaaaaagtccttctcatctctttccactctcagttccactctagtctacaaaatagcaatgtttgctaccatattaatgagtaggcatcagattttttttcctatgatggtacgtattcacatgtgtactgcataggaaaaatgtatatgggcatgcatgtgtgtgtgtgtattaagtggctgtttacataaataacccccatattctgtaggtattttattttataagcgtttttgtgacttttttcaagtaacaatatctcttaaatattttgtcagtgtatatagataaaattaaatcattttgaaggtcagcaccatgatgtgctgtcatatcctaatttcttgaaacattctgcattcttgcctgttacaatagttgcaatagaccaacaatttctactcatattaaattaaggacattttctcaatttcagtttagagaaccaccctctatcatcttagcacttcccctttcccctgtatcagaaatctctttttatgtgcagtagtcatgtcttggagtttctgtagtatatattttaatgctagaagttcttaatgtttttaaatccttccttctatgatttcaagtgttgccttcttctcacaaaaacatagtaggagtgaactcttcaagctttttgaacttagatatggatgtggaacttgctttggctagtcatttcttccaaaaacttcacaagccaatggtgaccttccgtgttctccgcctcgtgccagatgatcctagaagcaagtgttgagttggagccttcattaacctaggtcaccgagtgacaatgataaacaaagtactagcaaacctttattagttttatagcctgataaataaataaatgtttgttgtgctaaacgactgtcaggattatttgttatttcagcataacctagttaagcttaactgacgccactacacattctttggcttccaacttcacttactttcataagaaaacttcttggtataactgtctatactgtatttactttctcaactttatctttttcccatgacagtcattcttcaattaccatcactactctaaaattgcttccaatagccctaataccattcatgtttccagattcaagggttagttctcagtctctagcttgacgtctcacaagtattcaccatggtgaaaattattttctttttttgccttccagaataccacattctgatagttttcctcttatccactaaccaaaccatctgagtcctcttggtttatctcatacaatagccccgagtgaactttaaaaaacattaactttaccatattactttcctgctcaaaatcttcccaaggatctatagcatattaacatccatgctctttatcctggcctaaaaaccctgcaagatttggcatccacccactaatatgtcctcattgcattccactcccctccctaaactccagccacacacacctctcttctagttcaaatatgccaagatagcaaccaaattagagtctttgtactaattggtccctctgcttggaatgattttaatgcgtatacttccattgctgatgtgctatgcagtttttaaagaaggcttcacctcttgctattttcataccttagtataatccactcctttgagtatgacctggaattagtgatttgcttctaataaacataatacagcaaaaaatgagcagatgtcacttccgagattaggttacaaaattccatgacttctattttgctagctgaatttctccattgtcttcttggcttataagatctgatgaagctagctaccatattggaaaggcccacatggctaggatctggctgaccgccagtgaagaatcaaggccttcaatccagtaacttgccagcaactgaactctgctaacagccacataagcttggaagtagatccttcctcagttgatcctgaggatgagattacagccttggccaatgtcttaattctaacctgtcatagaccatgaagcagagaacacagacagatcatgcctgcatttctgatccacacaaacattgaggaaatacatatatgttgttttaagcttctaagttttaccttaaacttattgagaccaaactcagatttataattcagattagataaataatatcattggcttcttctcatgcaggtattgacctaaatgtcaaataattagaatgctctcctctacaacttaacctaaaattgctgcttcatcctcactaacaaatatctcaatttgctttctttatagcttgttgctgtcttatgacaaaaactgctagtggtaaccaaagagttcttctctcctacttcctcattaatagggctgctggacacatgatttaaacacctaaataaaatgaaaataatattaatattaaactcacaaatttattatgaagacaaataagagaaggcatgcaaggttcctggtacacagtaaagtacctgataaatgtttgctattgtttgtgtattttttccattatttatactgtagcactgccagtttcatttgttttgggacaaataattttgagtttctcctgttgccagatgactatctttgtggacagaattcatttatgataccataatgtcatagacttttagatctagaggggacatgtaacaatcaactaaaattaatattcaacaaccatttattgagtagctattcaggacttggctaggagttagataaagactccaaatggaagaggatgtaagttacaaagatacgttattctgcttttaaaatactataaatggacttaaaagacttggcaagtgcagccttacctccccacctccacaacccttagacccaattgccgacagtagactatgtgcttctcatgcttagatgtgccaggccatttgacaatggccactctgtggatgtccactgctcatgttccctgtggatgtgggccaggagcatcaaatactgtctttatggatgctgagcccctcagacaggaggtgatgccagcttgcacagaaaaagttctggctaggccttgcaaccagatggttggctgcaggcccagctacatttttttctccatttaatttctggtctgaaagttactgtttccagtggtaacctggggaccgtaaattatgaggcttgttgatgagttctgaaaagtactttgtaagtagatcttatgaaatgcattgagcacttaagtcccagacacagcagtgttttcaaacgttatctcatttaatccttataccaaatttctgatataggtgttattgttatatctactttacagataagaaaactgaggtttggggacataaagaaaaaaattaaaaatagtcccttgaaggaaagctatgagaatgttgtgaatatttaatattttctttcttaataaagtctaatttaatatgtagatttttttgtcccttagagcctagttggtaaaatataagttagaaaacaaatctgacaaaattggcactagtatttgaccgatcacataaaaatgttatgtaacatgcagtagcatatagtagatacgcatcaacactgtacacagaatataaagttcttttattatttaatcacataatgcaaaggcaatacttttgattaattaagggtgggtccacagactgaagtttctttttgctctttagtcattaaaaatactcatgttgcatcatctaagatttctactttccttacagaagcaaaggtcttcatttacggctttagttaccttacagaagcaaagtcttttttacattcttataattgccttctccaattatttaaaactttcatatacctaaagctacaataatttgagccaaatgccttttatgacttgtttcctggaacatacacatgacttcagtttctcaatgtttgaaaagaagaaagcttaaagtttaacatctaattgtaataaatgggtttgggaacaaatgcaacttactcttaggaatggcacagatggtgactaatctgcaacgtctcttaaaggagactggagcagagggcacaccttggccactgtttacttatctttaagatcacatttctttctattgacatcagcatcacatgaaccaatgttttggatttttcttcatcattatattcctagaatattcccttactaataattcctatgtcccactggcttgcagaaatgagtagggatacttttacaattgagaagaaaacacaaagtatacttaaaaaagtcattcactgccaaagaaaattccacatatgtggcttgatttcattgggaattattaaaaaatgcaaggtatgctttccctgtattaggactgttaaatggaacactctgtgataatggaaaagttcactataggccttttctccctgttgggttgtttctaatcttatcaatttgtaagatggttttatatattctgtagctacactgttcaatatgtcctcattcattacatgtggctattgagcactttaaatacggctagtaaaactgaagaactgaatttttcattttatttaattttaattcaatttaaatagccatgcataacttgtggctatgatattgtctaaggcagatctacatctattattccggctgacttaaatacagggcttctcaaatacaaggccaacttatttgattgcatatatgacaatgtaatgtaagttaccagagtgatttcatgtaacgatagaatatttcttcttaggtttagtaaaagagggtgtgtgagataagtacatgtctgcacacaaatatatgctagctatgtaataaattattcaccacatctctagataaattattttcattttggtttaggggagtttgagccttgtttatgtgtgagaaaagtcagaaggcaaatactttgccatcaggatacagacagacaaattcttgcttggaataacataaaaatgtacgtaaatattcacattcttaccaatgctcgtgaaatgaactgatgagaaaacagaaatatgcaaaataatgcaaatatgaaagcagatcaactggcaagtcctgctgtttgacatctaatgatcattgcataactacctggatacaggaatgctatttaaatcatgtctgctaagtctacctagtcagcttcccggtatattcaggagttggaatccttactagcccatgaattgcctcaccccccaacttggaaatcatgttttgaagcctaatttacatcagaatctcccaatcagcacaagtaaagtggactgaacgttttcatgtagaaataatctactgatatctgtaatgttgcaaaaatacatatgtgaccaagcaagatataatcaaaatatgtgtttgcattattttactgctactttgatattttagtgttttttgggggggcatttaaaatgtcttcttttaacaaaaatattttaaatgtacaataattgtggaatatctttcataacatgaactggccatgttttctgcaaaacttaaatgaatgcaacttttgcatctggattgattttaattatatgaaagaacaacccccagatactatttggacacggaggagagataagtataaggtatataacgagagtcagcaaacccttttcaatgtaaatcatagcattatgtattgtcaacactagtaatttgtctgagggtagaggggatgagtctaatgaatacaaagattaaatatgtgtttaaagctataatatactaaaaattttgtagtattgcacagttttgcatcctgtgaaaaatccttattggagaatcacacattgaaattttttcaaatgctcttgtttctctgctcactggctactcaatttgatggatgttattaagttatgttcagccaattaatatcacacaagagaataaaccgattacatttggatcttccctcttgtggaatcttcaaagaataagtgtttttcatcgaaagagccaggaatggtagtttctgcatgatggtaaagatgttctgtgcattaaagggaaatgaaataaaatgctttaacgaagaaacactgaacgttgtggtctgtgagactgataaacatgctgaagtcggaattgcgatttagatttatgaatcaacagctcccagagcaagtggcttgtgacccactttcctcaagagacatcaacatgtgttttgcattaatttgtcttgatagcctcttgttgctagcaacttttgtgggagtagaaaacacttcgcctttgccaaccatgtgtgtctctctcctgcacccctacccttttttaggcaaagcaaaatgagatagcttcagttttacagtgactactagacacccaacaattgaggaacttaaaaaaagttcataattggcttgttttaaatagagcatctttaaggctcttgaagtctttattgataaattttagcaaccttttggcagttattttcgtttaaattacattgttgaaatgcgcatttcacagattgcaaaatatgtctcgtggttgggacatgaacacaaagaggtattatgaatattggattatcttagagatagttttcttggcctttattttaaagcctattcacgaatatttgtctaagtgataatattgtagatatatgatgaacacatgattttgactgctttttagccaacagttactaaattgtaatcaccaatatatagtacagttctatattcatataaaagctcattagaagggtatagaaacttctaaactagctgggtcaaatttcaactcttccctaaagtcagtgttagaaagtattaccaatggacagggacataaccaaagaacaacaaaaacaagaaagttgggaaaggctaaaatctggagtttcaatacattctacaatgaaccagtgaaaactctataattaactttatatttgatcctggcaaataagctatgtaccacattaaaacaaaacaaaacacaaagtgaattaaaacaacagtcaaagacctcacaatattatttttcaagtggttgaaaaccaccactcaaatagcttaagcaataagtggatgcattattataaaactatgcccttatccaagtgcttatgtagggtatattccatgaatattgcaccaactttttcttttaagaggtagtaattccttgaatctattctccttcctattttgggttcatcttcaggctagtagcaagatggttgtagaaatttcagacattatttccaaggagaaacccattaaaaagcaggaagagatgtgggtttttgcatatgttcctttatgtgggtgaggaggcattatacaggagcccccagcagacttctttcttatttcattgatgagaattaggccacagttcctttatgtgggtgaggaggcattatacaggagcccccagcagacttctttcttatttcattgatgagaattaggccacatgttcactctttaatcagttgttgacaggagaaactgggttccaaaaattgccttagacaaatcaggagtgacctttgacctaaagacgttgctatattcacatggaggggaaaaacatgcagggagtgggtgaacatgcaaaaaataatgtgaacctgtggataactgagggcccactttgttataccatttcatataagtgacttgagcttcaatgtattgttggtatctatgaggggttctgaaacaaatctctggtgaatacacagggtctattataagtcttatgtattattgaagtgatttaattgttggctttccagcttccttttgcagtctgaagtcttctttatgcatctgggaatattaaaacggttggattagaacagactccagtccacaggaactacagtataagcgatgaactggtttttcacaattctattgcctaacaggagaagctggacgcactatattagtttatcttattcatgatctgcaggatttcttcagaagtgctctcttaaagtcctaactaactggctgtgaaggtaacgacttcatcctcaaacactatcatcaattactgacttttaaaggctctcttcaacaatttagctatcaatagaaaccacacaccaatgcgtagattttagtgacaggtatttctatggaatggagaaagcattgtgtacagggtggttcaacaagtttggcgaggatttaaaccttctcgtaaagaatgtttacatattaatattacatattataggttggaactaggtttcctgagacaaaacttgtctgggttagtgtttttattttgtgatatagttacattaatattagaaaacattatatgcattcactaatgctaaaatttcatagtgcaggtttgaacttaacgtcaccatcctagaccacattatgagatgctatacaatggtaggcatttggtccacttttgttgtagatattcattctcattcagcaaataccaattgaaatagattaaactttttatgataataaatcaatcatcaaatatttaaaaataataagacatcactatatgtgccagtcaaaatagacttctgataacagttggttatatttctgttttacttgaaagtaatgaaacatagctacatttggatttccttttgtgtcttactaccaattccattttccctccatttctagaagaaatcactcttaagactttggtgtgaaacctttctggtcatttaccatatatttcattaaaaatatttcccacaaatttctcgatgaaaaatttatggcctgcgtttgtttgcttgttttaatgacagtgcagctgtcatgagattgtgcctcatagacctcctccaacaaggggagtaattgaccaagaggctcaagtgctgccctttgaaattcattgtggtggttatgctaaggccaagccttctatcagatgcttcctgccaatgaatgagtgctaagaagatactaaagcagccttgctcttgagacatgtctgtgaactttgtctcaaggacttcccattgactttcttgaacatttcttagacaagcaggggctatacgtgtcttccacccaaacttctctccctcctgcacagtgtcagactagcattacagtttgatgactttcccagtttttgtcagctccctttttatttcccttcatatggacatttcctcttataaaatctttggatgttttattctctcttggtgactgcttcttgcatagccaggactaacagagatggcctcatacaaggggaagacttctccaattaaatgacttaataatatattaattttttggctctctagtaaattctatatagatctactgtattttttaaaaattgacctacaggattcagttttatgaatctattacagctgacttatctattcccttattgatgggtatttatcttgttttgattttcttgctattatgcaatatgcttcaatgaacacactcgtgcatgtcatattgtgcacatgagcaagagtaattctagttacaaacctagaatttaaattattggatcagaaagtataatacatgatcaattttcctatgtacaactgtatttcttaatataagaaaaatagatagaactaatttatatttccactggtagagtgtgaattattcttcctctctattcttgccaacacctaatattgtgagattgtttaatttcctgaggctctcatttaacgctttagtatacatttctcttattctaatgaactgaacatcttttcatatgtttactgaaatttctcagttcctatgatgtcccatgcactatgttatttatgaagacattttaaaatcagaatttataaacttaaattgtaatatgattcagtgtattgtacagaatgaaattaattttgcataaccacaggggaaccatcagccaccatctatttaaatacctccaattaaataatttttactaataccccatgtcttttaatattgaagaattctaagctctaacaaatagccctgtaaagtgcttctctatttagtaatcctcaaggtttaaaatccctatattcatgtttataatcacagactggtaagctctttcaagaatttgttttcttcttatagttcaaatattttttcaatgtgctttaaatttatgtatttaatattcctgttctaaatttgaggtcaccaaggagacatgtctagaagtttccatttgttcaaagacaggattgctacagagatagcttctttatatttttattatttctcagctgtttttgttgtgtcacttccaaataacatattaacgaagaaactagtttgatgctttattacaactggaccacatcccagatatattgatgcttcagtgagggcactttaatataaccaaacccacttgaaccaacttaaagaaagtagggggaaatatgatatatgctttatgtgtcacataaaagataggaatgcattgggaacttcaaaataaactgaaagaatcaaatgggaaaggaacactcattctgcctttcatgtctgttcgtttccttgaatctatctcatttttcatcctggttgaatgttctggaatgttcaacaagaatattcttcttcagagaccacatgttggaaatgtagcttctataacatcctgagtttttctattactggcccacccacctggaggacaaccggattgactctttccatctttcagtttccagggaagagatttaaagagctcattttgggttagctgcccaatcccaagtcagtagactgcatttagtatgatagagatgtttaatatagacatggctgcttcgtatgtaccaacacggtatgaagaataccagtcacaaactagagtggaaactgttctcagacataaagttgggcttgataatcagtgtaatcgatgttcattgtagctggtgaatgtgggataataagaatttactaaactcctactttgctttcagcttttagcttggtctttgagtgagaggactgaaacttgaggctattgatacttccagcagttaacatgaaagtatcatgtaatttctaccatgtgtcaggcaatatggcagactgtttacatgttacctcattaaatacaataaaccaaagggtggctttctgatactctgtggcagccctggacatgcactgctcagattgcccttccagagaaccagctgcaggtagcattgttgattgacaacttctagttgccactcctttgaattcactcctttgttcatatcagaccatctttcccctgcaagatatggctgcttgctcccagccacagactaagtctagcagggacactggaattggctggttcctgctggacaagtttggctcagggattccccatcagccataagactttttttttttctttagtattgtgctgtggtctaagctcttcatatccaattcttctttgtgtttcttctttcacagatgccagacctctattgcagtctgaagtttctacttacttttgctctgtctccctttatctttcacaggtgtctttttcttccttttcttttcttctttctttccttccttccttccttctttctttctttctttcttttttattctttctttccctttcctttccctcccttccttccttccttccttccttccttccttccttccttccttcctttcttctccgtcacccaggctggagtgcattggtgtgatcttgcctcactgcaacctctgtctcctgggttcaagtgattctcctgcctcagcctccatagtagctgggactacaggcacatgacaccacatgctgcttatttttgtatttttggtagagacgaggtttcatcatgttggccaggctggccttgaactcctgaccgcagatgttctgcctctctcggcctcccaaagtgttgggattacaggcctgagccactgcaccccaccaaaaggtgtttttcttcataagccttttgcatatttagttctgtcttggcatctgcttcttggaagacccaaactgacatacacccattttatagattatttgttgagaaaataaataagttttccaaggtcatatacatattgttagtaaatcctaagtgccaaaactaaacatagatctttctgacatgaaagctcatattctttcttctatatcatgatgctttccactacagactccaagtgttatgataatgtaatcattaatttaatgtgcaaggatttagaataatgtatggtacataaaaagcaatatgtaactgttattattctgttgatttttgccattgttcacatgttgtagaaaatgtagaaagcagttcagcacagcaacttatggtaaacctatatgggagatgttaaaactggccattcattctttctctcttgcatctacccctttgcaatgtgacagtgcatgcctttttattttacacccctggaatcaggattggacatgtgactttatttggccaaggagacattcataaacatgatacaaacaaagttcttaaaagcacttatacttggggattgtttttcagtggccctggggatctttctatcaccttgtgtaaaagtccaagctaccctgcttcaggataaaagggcctatgaaatacagcaaaattactaatgctaaagacctctcctagatcaaacagctcctagatcacctggtagattattaaagatgcatgtgtcagaatagccaagatgagcagaaaaatgatccacttgagcccagcccatatgactgaacacagaattaggggataaacaaatggtcttgtttgaagctgtaagttttgaagtggtttgttatccagcaaaatttaactgtgaccataggtgaggaaagacaaatatttgtagtggtcactcttggttgccttttcagtggctattccttctctctttcttattaccgttacagtaatggtctttaggaatcggacctatagcttcatgaagctctccccagttgcagctaggtaaatgttgattagcataaaggtaagcatagtaatgttatttattttgctaatgactaaacagcaggtataatgctgacaaatgactcacatggaaattatcctggagaggcttctggaattgccctcactcttaaaaaggacataccacatcctgcctttggacatttttgtatgataatatgatgcttggatctctggcagccacctttaaggtatgaggtaaaagatgagagaatcacaaagaagatcacaaagaagttgagaaggataactgatatcactgacccaaagaattaaccaaccgtttaaccacctacccaataccttctgttatgtgggataatgtattttctactatataagatgtacaaattaggtttttctataacttgtagccgagggtatcattttagacatagtggttaattttaagcttcttagaatttcaacaaacttttgaaatgagtacatgaatattcatgcaaaaagatgaagtgtaaccactaataaacttcacctttcaaattttctcttctcttctctcctcctcttctccaaacctacacagagctttataaaaatactaagttagaaaagcaacactttggtttcataccaagataatattctctaacttttccaagtattatcatatatttcaattctaaaaacacagcttattcctttaaaataaatttatttaaactggaggcttatatgacacaaaatcaaattattagaagagaatctcacataatagctttgatttattttgagaggaggatttgaacccttcaggcaaaaccagaaaccatggactaaaaatgccattttcaaaatttctcatgatgttagccatctaggtagggaaataaaatgtattttttatttttagagcaaaactgtatccactaggatgcactgttgcctcatagctttccaataaaatcccttatttctaaagcgtgttcatgaattgcccctgccaaatcaggaatgcctcatcacacttccttcaagcaagcatgcatgttgctgtttctttatttcactgcaatccagaaagtgtcatgctgtaagatagaaaagaatgatgctggaaagcagctgacatgcaataggtttgattactggcaacactctaatgtctgatgagaacactgcagccgagtcctgccaattatttacatctccaaaggataaatgatttcccaaatggtatccaaccaccaaggcacccagagtgttgcagaaatgtttctaaattgtgaatttgaaggataactatatgaaagcgatgttcatggagtttgtgccctagcaaagattgacacgaggcatctagacaacctgagtctctcccatggtatgacagggttaattataaactcttcaggtaatctcatttggcaggagagatgcaaccagtggtagagggtgctgactcggaagggagaaagttatcagtctatgagcaaataatcactgagcgctcaaagcatgccaggtctcggtctttatgatcagaacttctgccaaagatgagtgggccacatagggcaaaggctttaatggggaaagacggaggtctctttatcacagccactggtatctgtggtgttgatgaatacctgtaaggacatggagttacattttgatatatttcttctttaatttagtacattaaattaaactaggtgttgatgagacaatgatgaaaatgctagcatgagctcaaccctcaagaaaattagaaaatctgaggaatgatcctcatggcccaaatcacagattcctgctggtcagaatcttcgcaacagttagtatattttaccatctgcttccatactgtcttcccagccacagcttccaggatcaactccatgatatatttttggctttatgcctcatcccttaaacacacacccaaacagatacgtacatacctctttcatccaagcttcttcctgaactcctgtaatttggcactggtctgctattctctcagattgtaataaacttagcttcttctcccctctctacttacctttcatctttttatttccacaataaccgtgacttcatctacaaagcctgtatgtatttttctgaattacttttttgtttcctaggatttagtaagacacatactgatatagacctttcattaggaacaaaacagatattagctacataaatactagctattttggttggttttatcttttcttttatgttttgtaccacacatccttggttacatagaacatctatacgctatggtagattgtctacaaaaatggccaccaacacttcttcttatccctgaatatccatatactccttccatcaagtggtgaggtctatttcctctccccttcatcccacaacttgcttaggcccatagaatgtacccttagtagtgttttaaaactcccagaacaaggtgttaagggaactggaggttttggtttgtaccctgttgggatccagctgccatgtgaaaggcttagagaattattacagacataaagatgaatggagagagagaaaaaaaaaaaaagaaaaaacaagagggagaggacagccagcactgcctttccagctgctccagctaacatacctgggagtgagtaaaccatcttggatgttccagtcccagacaagcttccagctaaatacagctgcataaattactcaaatacaatccatgtgcagtagacatgatccatcaccgtgaagcctggcaaaattttggacttgtggggtaacaaatggcaattgacttaaaaccactgagttctggagtggctatgtatacaacagataattgaacatctacaaggtacagcatgcaagctctttgcagtggctacatatacaacagataattgaaacgtctacaaggtacagcatgcaaactctttgcaggagagaagtatgccttacccatttataaatctcctaatgcctggatcagtttcatgacaatttaatttaatgtcaatgatggcattaaattaacatctcaaagtgaaacaaatatgctcactggctgcctacagctcctgttcaccttgcatcatttgaatgagctctttaaacctgaatgattgctgcagatattgttggcacttctgcttagctggcatctcacattgtgtacttttaaaatttgctctgaaatgcggactttccagcctgattgcaagcccagggtttatcattctgtcccaagggcattgtcctaaatatcctcttgcactgatccgttaatgtggcctgatctaccacagtcttttaagtttcaaaggaaatctgaaatcatttgtagctatgaacaaatagtctttcaataataagaaataaaaagagatatggaaatcactgtctctacatatccactgcccacataatatcataagttccagcttatgtggcactatttccatctaatgttgagttgtgttccagatttgtgatatcttcccaagtactaccagctcttcttgacctccacaatgctgtgaaatgtcgaattgttgaaacttatgcttcatggtttagtgttgtctttttctggactccacacctcctgtgcaaacatctctcacatttgactgccaacaaatcttgagcctggcttcagaccttgcattaaaatatcaataggaaccagtcagaatggtgattattgaaaagccaaaaaagaacaaatactagcgaggttgtgaagaaaaaggaaagcttttacactgttggtgggagtgtaaatcagttcaaccattgtggaagacagtgtgaagcttcctcaaagacctagagacagaaatattattcgacccagcaatctcattactgagtacatatgcaaaggaccgtaaatcattttattataaagacacattcaagcctatgttcattgcagcactattcacaataccaaagacatggaatcaacctaaatgcccatcagtcatagactgaataaagaaaatgtggtacttatgcaccatggaatattatgcagccatacaaaggaacaaaatcctgtcctttgcagggacgtggacgaagctggaagccattacccttagcaaactaacgcaggaatagaaaaccaaatactgcatattctcacttataagtgggagcgaaatgatgaggacacacggacacctcacagggagcaacacacactgggacctgctggagggtgcagagggaggagggggaggatcagtaagaacagacagtggttgctgggcttaatacctaggtgatggggtgttctgtgcggcaaaccaccatggcacacatttacctaggtaacaaacctgcacatctggcacacgtacccctgaacttaaaataaaagttgggaaaaaagaagacaaataaataagcaaataaaagtgtgtgtcacctccaaagaaacagaagagagaagaaatgtcagtgggagaggctaacattagctttgacacatgctatttatcttgttcaagtagaaatgtgacgccatgcttagtttataatatggaagagatcatttcctgtcaaggtaacaccatttatgaaacctgcctttccagtgtactggactacacttttacttccaatgttcattttattgaaactgcaaagtatacattcaccataggcttctttgcaataattttgtcttgtgtcttgtaatagagttctctagagggacagaacgaatggaatatatatatatatatatagacatacatatatatatacatatatatatatacatacatatatatatacatatatatatatacatacatatatatatacatatatatatacacacacacacacacacacacacgtatatatatatatacacacacacatacgcttggcagaagcactgcaggcaagataggcgaacccatatctggagtaagtgtcttttccagtgaggacaaacctctgccctttccatgatggaagaggtccaatattatatatattatatatctctatatgtaatatatatgatatatattgtatatatacaatataatatattgtatatatttatctaatatatagtacatatactatataatgtatatataatatatattatatacatagaattttattaagtattaactcacctgatcacaaggtcccgcaataggccatctgcaggctgaggagcaaggagagccagtccaaaactgaagaacttggattctgatattcatggggaagaaacatctatcaccaccgtgggagaaagatgcaggctgggaggctaggccagtctctcttttcacatttttctccctgcttttattctagctgcactggcagctgattagattgtgctcacccagattaggggtgggtctgcctttaccagcccactgactcaaatgttaatctcctttggcaacaccctcacagacacacccaggaacaatgttttatatctttcaatcagttgacactcagtattaaccatcacaagtccaccccttgtcaacttgaacgcatacacatctcctgagatcatacataatctttaaataaagacaataataaagtcatactaacgcctaacataactatccttcgtataaccagaaatgcagctatccccaatccaaatactattacgtaaagttaataatacttgaatgctgatgtgaagtcaataagtcttatgtcacatgataaaggagaaaggaaataaaatgaagatattttcttagtagaagtgtacacatgcacaaacatgtctttaagaacagaaggaggaaatactcatgacaattacagtcctcgtttctgcagctggtcatgtggtcatagctggtattgatgactaacttcttctcctacccattctgtattccctttgccttcagcaagcatctcagcaggtcgtgtttttttttttcctggtggagagacccaaactttcattcctgaaagtctgggtcatttgtagtcctgcctggattgggcttttgtagcttcccattgaccttaatcacagggcatggtaatactaagagatgccctaatggatctcctgtattccatgcatactcttccttacctccattgtggagtagtagactgatttcattgtgatagtccgggtcaatcaccccagccaacactgtaactcccttcttagcctgttgacttaaaagtaagaggagtccaaagtgtccaggtggcaatcttaacttccagtttaatggaatcgttattgtctcttctggtggcagcgttcctccctctggaactaagacctctggccagcagaatgtaatgtcgcaggaataggaagcaacaattttgctagtggatcactaggggtgatggtgagtggtgacacttccacttccaccctttgattcctggaccagtgaatcctggaccagtgaatcctggctatggaagaaacagtatcatatattggacactgattcagagcatacatggccttctggaaaactttggcccagccccacgaagtattgttacctagttggtgttgtaattgtgacttcaaaaggccattcattccaccgttctatcaatccagctacttcaggatgatggggaacatggtaagaccagtgaattccatgagcatgagcccactgccgcacttctttagccataaggtgagtgccttggtcagaggcaatgctgtgtggaataccatgatggtggatgaggaattccatgagtccatggatggtagtcttggtagaagcatggcatgcgggataggcaaactcatatctggaataagtgtctattccagtgaggacaaacctctgccatttctatgatggaagaggtccaatataatcaacctgccgccaagtagctggctgatcaccccaaggaatggtgccatatcgagggctcagtattggtctctgctgctggaaaatttggcactcagcagtggtcatagataggtcacccttggtgagtggaagtccatgttgctgagtccatgagtaaccgctatctctgccaccatggccactttgtccatggacccactgggcaatgacaagggtggctggggaaagaggctgagtggtctccatggaatgggtcattcttcatccttcattattaaaatcctcctctgctaaggtcacctgttggtaagcattcacatgggatacaaatgtcttcacagtttttgaccactcagagatgtccatccacataactcttccccaaatttctttgtcaccaattttccaatcatgcttcttccaagtccatgaccaaccagccaaaccattggctatggcccatgaattggtatataatcacccatctggccatttctctgttcattcaaagatcacaaacaggtgcactgcttgaagttctgcccactgggaaaatgcactggacttattgatttgtgaggcatttgtgtactctccactgccgtccttcatggatgtcctagaaaggggctgtagtgctgcagctgtccactttcgggtggtgtctgcacatcatgcagaaccatctgtgaaccatgcccttgtcttctcttcttctgtcaactgatcataggaaataccccatgaggccaccagtgcaggctggggagagaaggtagggtgtcaggagtgcagaccatgggtgtttgagccacttcctaatgtaacttacttgtgccttcaggacctgctagagtcagatcacgtatatactacttccatttgatgatggaatactgatgtgcataacccactttatggctagatgggtctgaaagcacccagttcatgataggcagttcaggttgcatggtgagttgatgacccgtaggcaaacattcagtttccaccaaagcccagtaacaggcaaagaactgtctctcaaaaggagaatagttatctgcagaagatggcagggccttgctccaaaatcctagaggcttctgctgtaattcacctatgggggcctgccaaaggctccaaccagcacacctatcagccattgacacctcaagcaccattggatctgctaggtcttatggtccaagtggcagagcagcttgcacagaaggctggatctgttgcagagccttctcctattctggaccccactcaaaactggcagccttttgggtcactcgataaatgggccacagtaacccacccaaatgaggaatgtgttgtctccaaaatccaaatagacccactaggcattgtgcatctttcctggttgtaagaggggccaaatgcagcacttatccttcaccttagaaagaatatctcaacaggtcccacaccactggactcctagaaattttactgaggtagaaggtccctgaattttagtctaatttgtttcccattctgtgacacacaaatgcctcatcaataagtccagtgtgttttctacttcttgctcactggatccaatcagcataatgtcatcagtgtaatggaccagtgtgataccttgcgaaagcaaaaagtgatcaaggtccctccaaataagattatgacacaaagccagagagttgatatgcccctgaggtaggacagtaaaggcatattgctggccttgccagctgccgacaaattgcttctggtgagccttataaacagaaatggagaaaaaggcatttgccaagtcaatggctgcatggcaggtaccaggagatatgttaatttgctcaagcaatgaaatcacatctggtaagcagccgcaattggagttaccgcttagttaagcttatgataatccactgtcattctccaagatccatctgtcttctgcacaggccaaatgggaaagttgaatggggatgtggtgggaatcaccacccctgcatctttcaagtcctgatggtggcaataatcttcacaatccctccaggaatgtgatattggttttgatttactatttttctaggtagaggcagctgtaatggcttccatttggccctttgtcaccataataaccctcaccctaccagccagggatccaatgtgggggttctgccagctgctaagtatgtctatgccaaatctgcattctggcactggggaaatgaccacagcatgagtccggtaacccactggactcactgtaagtcagacctgagctaaaactccattaattacctgacctccataagcccctactttaactggaggacgacagtgatgttttcggcctcctggaatcaacatcagccaaaagccagtgtccagtagtccctgaaatgtcttattatttccctttccccaatgcacagttaccctggtaaaaggtcagaagtcttcttggggaagaatgggaaaaagattcactgcataaattgtcggtaatatactggggtctttcctcaaggggatccggcctctccttcattcaaggggttccagatctgtaaactggctcaagtctggaaattgattgatggacgatgattttctgtttttataattcaaagtagtcttttgtgcatttgacctagaaattttctgcttgtattaattaagtagaaatacagtagtcttcctatcattttcacttctagcaacaccgtgattaattagccaataccagagctctacactagtcagactattctgattgctgccttgcctctgctgtccatgacagtagctatgcccaccttgcctttgatgattgagtgccgccacttggcctgtgccacctcaggatccagttattcctactctatttaaattttgtagttgagtgactgcgggtcccactgttagatctgacatacagagaagagcaaccacagggctcttcaaagatgcaggtgctgccctcacaaatgtattttgcaaggcattagtcaagggtatatcttctggaccctcacagctgggatgagtaggtctaaagggagtaatccactccaccatccgaatctccttaagcttttggatcccttcatctacattaaaccaagtgagatcaggcatttccagcttactcacagtgggccatcttttaatccatatttcagctaaccaagcaaataaactattagaatctttttaactccctgagctgcaacatgaaatgcagagtccctacttagtgggcccaaatcaataaattcagcctgatccaactctatgttccttccaccattatcccacagccttaatatccattcccatgtctgttctccagatttctgtttatatgaattagtaaactcaagcagttcttttcgagtgtaatgcacctcctcttgggacacactgtgaaccccacctctagggacccactgggactttagttatatgtctagaagtaaacaggggtgttgggggttgctcctaaggagaatcaacattatcttgcctggcaactgcctcaggggaggcctcaggcagcacagggtatatctcctcagacaaaggtagaaaggctcatgacagcatgggtcgaggaggggatattgccactactggggatggggaagctgtttcttctggcaaaaaaaaaaaaaaaaaaaaaattcatcagcagtgtccccagcttcatcaggatcctctcacacattcccattccaagttgcaaggtcccattcttttccaatcaatgccctcactttaacagtagatacctggtgaggcggttcatgcaccttttcttgcagtcagccacttgcatggtaagagcttgggtctgttttcccaaatttcagctctttctctacaggaggtaagactctcactcagggcaatctaatcagatttgaagctcagtatctgcttctgaagctgggagatagaatcgctgagttcagcattttctttcattattttatctgctgaacttaggagcaaccaaccagtttcattacattcttgcttctccacaaatggtcaaaggtattatgtgtagagtcactaaactccttgccactcatgagcaatgaatcaggagtgtaaagtgcatttactttgcataactctgtaaacagttcatgtcgatgactatcagggtttgccatgctattagaagtagagtccttagcatttttgagtctaatcatattaagcagccaactccagaaaccccaaaaccaagaaaagaactccatccttaacattctgttcctctagaaccactcctgataccaaaatctgttattaatcagggttctctagagggacagaactaatatatatgtattttattaactattaacttacatgatcacaaggtcccacagtaggccatctgcaggctgaggagtgaggagagccagtctgagttccaaaactgaagaacttggagtccgatgttccagggcaggaagcatccagcaagggagaaagatgtaggctggaagactaggccagtctctctcttcacatttttctgcctgcttttattctagctgcactggcagctgattatattgtgcccacccaaattaaggtgggtctgcctttcccagcccactgactcaacttttagtttcctttggcaacaccctcacagacatacccaggatcaatactttgtatccttcaatccaatcaaattgacactcattattaactatcacatttctattctgttcctaaagccacactgtctcaacttcttttaaagcacctttttggcctgggcccgaaggctagacaaatcaatttagtccagtatcaagaacaaggcaaaacaagacaaaacaaaaaaattccacttttctctgcattaagttgtcaataaccctaaagcatcttccatgtgtaaacactgtaaacttgacttctttctagaagattaaagttctggattagtagttgtacataaacaaagtatgcaggctaaattatttttacccattattatgtccaatgtctgcttattatcagggaggactttgccagaacccaactttgaatttgttcattcaaataattagtacactaaggcttatatacgtgaaacaagtaaaaagtaatcatggtgttatgtaaccaagtattagaaatgtcagatgggatatttgtcagcattcagtgatttaaagcttttgatatctgtaaaaaaatgtattttctctcttttattagtttcctgtcatgagacgtttgtgcttctttagtcattgtcacttgattcaaacagtaaagtctgtgctggatgaacattttcatttatataataagaatggctttaataaacacttcactcaggggagatatttaaagtaagttctttaaggcctggcactgtggtttacacctgtaatcccagcactttgggaggccaaggagggaggatcgtttgagcttactagctcaagaccagcctgggcaacatgccgaaattcattctcttcaaaaaaaaaaaaaaaaatacaaaaattagccgggtgtagtggtgggcacctgtagtcccatctactcaggaggctgagatgggaggatgatttgcgcctgggaggcagaggttgcagtgaggctgtactccagtctgggcgactaaacttttctgagaaaaagtgagagggcttggaaggatggtttatgacaatgaaccaaagagctctagctttatttgcataataagggagttccaaagagattagagggatttggaagcttgcctgtatactaggcaaatgatccagcgtattcttgtacatgctcatccataacctttttgagtaggtagcagtctgcacaacctgcttccatggcacggataattggaacagtggttgtctttctccagaatatttgactgagaatcccagagcaaagttgattatgaacttggaaggtcatataaatgcaggtgttagggctggaaggtcatatcaacacaggtgttgggtctgccattttagagaataatgggtggtggaagaagccataaaaagattagaggaagaaaaaaggggaaaaatgagtaaatgtctgaagggcagacatgtagtatctcatggcagaggcaaaggcatgactgattctcaaagctgcctgccttcctgcccttcatatgaatggctgcccagatactcttaagccctatatttgtatgtcctttcaaaacttccctttttttttaggttccttgagcaagccattgtttcttgaaaccaaaattacctaatgggtgcagtatttggggggaaaaatgaagcctaagggagaatactacaaaggaaaacttatgaactgataagagaagccaaccaggaaggacatacaagtatgaatgagtaagtcacaaaaggaagatggagataggaagaactttgtttggaggctgaaatcagcaaaatcgagtcaaaacaaagtgtggacatactttaagggaaacgagaaaggttaatatcatgggtcaagacaatttaggatgaagtgaaagcattgtaaaggcagtgccaaaaaaaggttaagttttcatatatcttctctctgacagattattcaattctgacatttttatacctcctttcttcactgaaaatagtcgaaaacattgctttgttttttttacaacatacttcatattaacctgtcctaattaaaatgtgaacttttgttttatttgtaagagatacttaaaatgttattgctacagtgtacactattttccctctttaataatttgcaagtaacataattccttaacaatatttttatggaaaggtcagtgaggccacaaaacacatttagctgacagcacttggagtttctgcctttgaaaacatgttcagcagtttccaagtccatctatttcttattttgaactttctcttgcaaactacaaatgccgtgtgtatatatatatatatgaatatatattatatataatacatatgtgtgtatatatgtacttatatactatatatatatatatatatatatatatatatatatatatacacacaacatagtgaggccccatctctacaaaaaataaaataaggttaaaaaaataaaaattaaatcaaatttaaaaagtcagctggatgtggtgacatgtgcctgtagtcttagctacttgggaggctgaggctggaggattacttcaaccaaggagatcgaggctttagtacgtcatgttcatacccctgcactccagccagagtgatagagtaagaccctgtcctctgccaagaataaaaattaacgaaaaatgaaaaacatgaaaaatgaaacctatacagtcatatgttacttaacaatggggattcattctgagaaaggtgattttgtcattggtgcaaacatcagagtgtacttacacaaatgttgatgttataactggctgcacacctaggctatgtggtatagcttatggctcctaggctacaaacctatacagcatgttactttcctgaatactgaagacaattgtaacacaaagttaagtttttgtgtatctaaacatacctaaacatagaaaaagtacagtcaaaatgtggtattataatcttatgggaccacattgtataagcagtctgtcattgactgaaatgtcattatgcagagcatggctctgtttcatcaatagaaaacagcaccaagcagtcctccaacaacagcaccatgcctacagtgtgggccaacaggctggacgcactcatgcacaagcagggcagatgccaggtgtacagatttcttccccccagcagttctcagtgtgttccaaaccaatgctgcttgtagagccatttcaaattccgcatgatgcgtatctatgtgtgtcagtgcaacattcatctttccacacccatatacacagattcactttcaagcaaagaatgcttcgatacattgtgctggtcaaatgtcccactgttctcatgtccactccttataatggaggacaggggaatggagaaagctggtatgcctgctcaccctctccctcttcttcttatggcagatctagccattatcacttaagttcctgctgcccctgaatagcttttttcacatggtccctggtccaaagggacagcctcactgtggctctggcgatggcatggcagcctgaaattctttgacctgcctcaggaagccatttctgtttcctgaacagcctaaagtgatctatgcttatatcacaatcttgggcacatccaaacactctcatgtgtgcatacatattcaaccttattattattgttgttacgttattgttatcagaattgtaataaacacttacatagtgcttcctatgtgtgagacagtctcctaagctattaagtcatttaatcttcatcacaaccctgtgaagtaaattctagtataatcatttccttgttgcagaggaggaaaaccgacacctgaagggattaaggtgggatgcacaacttgcactggcaatccagttccagagcccatactctcgttccctacacacactttctttctatacctgcatgcacatgctcacacgtgcagacacacatgcatctgcctgctcgtccatataaaaatctaaacgtagctctagcactctagaccctcacttcatgcattgaaccagcatatgggacgtggctcaaataagcatattataaaatcttccacatgatttagattaatgattctatttagaaaccattgctttaatccatgtcttctgtggttcttgtctaattgtgaggcagaattgggaaaggcttcacagaggggagagtattttctaaatccatcttctctctttttacctcttttagccaggagccagcatgatgtagaactacatttaataccaaagggtctttccagattcccatagctctcctcattatggtcttttattatggaaaacattctctcacatctcgcattcttgcctcatctatctactccaagtgagtttggtagttagagactggaaatttttcctctttaaatactatacatttttaaaatctgtattaatttaggattgattaaatgggttaattccagactttccaaggctaacaccgtatcatgtggtatcttgaaagcctggaggttttgagatatctgctatttttataacctaaagagtgaagaagtggctcaggagaagaaaattaatctcagtgttttcatgggatagggatcgttctgggagtatagggagaaccatgagaggaaatgtaggaaaagtatgtactctacatatttagggagattcctagtgcatgacatttgggacataaaaccttttatattttttgtgagacaaacagacttgattcaggcttctctatgctatttatgagccccaagaaggcttagctacaaggtaggggacttgtgacttggagtttgttataatgataggaaatcttatgttaacaaaacaatatcaaagtaaaccatttcaatgaagttgttaactaaattctcttactttcctctccaatctggcatagttttcacaactccaaaactgagataacaatagtgccaccttcctcagttgttagacggaataaatgagtagtaccagcccacaaaatgctgaataagtgtcagcttttagtaatagaattctaattggtattgaataatataatttctgatataagggatcattcaaaagaattgagttttaaattttctactatatacagctagcttaagagtttaatataacactttgacatccatttttttctttccaaaactagcaattacatccagtttccaacatagcataatgaaatgtttagatacaattgtaatgttttatatttgagaaatcaaagctagagactggttcaaggagacatagctaccaaaggcagagtcagggctccaacgcaggtcttctgatgaatagtgagaaaataagacaaactatgataagtcttaaaatatggcataagttctattgtggttcagatgaagaaaggggaacatcttaatgggaactgatggatagagggtgcctgtttgaaattctgttcaattgcttacgttttgcctggatgtttctgtagattccactgaattagtcagccttactgatttgaggttctgaccatgaaagttggcttcagagtcatttcatcctaatccagttagaatcagcttcacccttttcacttacatgataaatcaggctcaagccttgcactctgcttgagaggaggttggaaatgagttcccaatttagaataagaccatctgcaccatatgtgggccatccaactgggactggctctgccctggctaccaaactaattatggatatatttcagggtgtaagttactaggcttaaaatccttaattggcaaagttttattttgttaaaatccctttgctttcgctttggaaaaaaagctcagtaatcaagataaaatatgtaatggactattaattcaaatcaaatttaattttaaaaaatccatgatgaatataacattaaaattttaaatgaagacaagattgaatacttcagagcccttcctctgtatcctcatcctaatctggccctctttccaataaaagtttttaaaagtaggcagccagcgtacaggccatagtttacccatttgatctaaatttaatttaaatctaaatatatatgtatatatttaaatctaaatatatatgtatatacttaaatctaaatacatacatatatatatagcatgaaattatcttgattatggagtttgggggtgactatttaaatattgcttctaaggcaagtgcctttctaaccccaccttggtcccaaattaggttcccagtagctttacagttgagatgcttagttaacccactgtctatcacacttaacttgcttatataccaacacatttttgcataatatctcaacacctgtgttccagaaaagtcctggtgtggaaaatcccagagaataaagattaatagcgcctattcatttcatgctcacagtaaccatgtgaagtagatgcctttatgatgaccctcattaaggaatgagaaagatgaagcaataatgattaaatagcttacccagggcaacatagcaagtaagggatgaggctgagctttagactcagccgggctgactcaagagtccatctcctaggctgctacaccaagttgcctgtgttcagcaggaagtaggaagcaggaaagagagcccaggtagtgcagagcaaaagatataggatggggaaagagtgttttccgtgggcattctggtccctagtttgatgctatgtgatgccatctgcatttccgcctttgggtcgtgcgattcgtcctgtatccttggagaaactctcatcattaacttgcactagcacaagtagatttctgctggtcctcaaaagatcttcaatacaaaaacaatcatggatcaaggctgattgttccaaaactccaccctgataacacccacattgctttcttactttgacatctgtactagtttttatcaactcaacaatcatttcatttgtattaaatgtttatagttttgtctacaggctattttaccactattgttattcttttcaaaaatagtgatatatgagcaaatatatatacagttgatcctccatatttgtggattccacatctgcagatttaaccagtcgcagattgaaaataatttttaaaaaattatagctgcaattgtacttaatatgtacaaacttttttctcttttcattattttttaaacaatacagtacaaccaccatttttaaacatttacctcgtattgggaattataagtattctagagatgatttaaagtatacaagaggatgtttgtacgttatatgcaaatagtaggctattttatatcagggacttgagcatctgtggattttggtgttttagggtcctggaacgaatccctcagggacagcaagggacaattgttcttttcttttcttttgaaatggggtcttgctttgtcgcccagactggagagcagtggtataatctcagctcactgcaatgtctggctcccaggttcaagcaattctctagcctcagcctcccgagtagctgaaactacaggtgtgcaccaccacgcccggatagttttgtacttttagtagagatggggtttcaccatgttggccaggctggtctcgaactcctgacctcaagtgatctgcctgcctcagcctcccagagtgctgggattataggtgtgagccaccgcacctggccaattgtacttaccttccacctgtactgtctccatgttgcacaagctttctgctcccattgtatctaattgtgttgtactcatagttgtcacacagtaactattttagaataagtaaaacccatttaataaccgtttctatttttacccagatacgagaacaaacatcatctccaacgcttttaatatgcaaccacatattttaagtgtaaaaagatgtttgctttctgtgcggttcacattggaataaacaagtctgaattatgagatgctgtaattccttagagagacactgatgacagtataaaacctgagtgcaaagctcaaatggtttgtgtgttcaccaaaaactcaattcaaaattatggctcaataattcaactttctctatgaggttgtcttatttttaatgttataaccttcctagattagagaaccaagcacataatatccacagacaaaatcaaacaaagcctagaaaaaaaatcaactattttttaagtccattacaactgagtagtatgagtaattattttattttcatagccagtgcaatggaatgtgagtctgcaccagttttggagggtattacctaaagttagctttgaaagaaatggtggaaatgtactagaaatacaatgcatgtttccgagcttactttgtgaattcttgtatcctcaaggttattcaaatccaaaataagcatattgaattccagatggcaaaacccacgatcctagaaagaagtgctggtaattctaatgcagattctaacagctagaaattattgaatagccattgtttgaaataataagagttgaaattactgcagtaagacagacttaaagcctatgaaaaattctgttctctctctattaattgcaaaagtcctttgggaaggcttagctgtccctctctgatagcacccttagagggtcagaaatacatccttctgaagtcttacatacttcagttaaatttctgggcttgattttctcatttgtaaattggcaatgatagtacttatatcaaaatattagtcaggatttaatctattaatggataaagtgtgtatcggctatgttataaatatacaacattgctgtttttatttgttattattttactcatagtgtttatctctctggtattaatttaactaaattttctttgagactatattataaaactataactataagactgcagtgagccgagattgtgccactgcactccagtctgggcgacagagtgagactctggggttaatcaaaacatcctcaggtttacaacttgctagataagaaggactaagttcaaaattggcctttcgaatttcagaaggtacatttaactgtttgtgtattactgtctggctaaagatgaacctcggtcaccaatcagggttttgtcaagatggaaatttcctcaatcatggtacagttgtgtgtctcatttcctctggaaaggctttttctttggcttgactactgcagctcacacttttgatttgactctgtctttcttttcaagattgaatgcaagaaacacatttttggaaagatatcttggaacctcttaccatgtaacaaagatgcctgtcctttctaatttttactttgcacttatctgaccttacaactagactgtgaactcttggaatcacggcactattttatacaattttgtatctcttacgtctaaaccaatgtttagataatcttagacattaaatacactttgaatgaatgaaaaacagtgtaaggtatgcaaaatattttttaaaacatggggcttagttttcacaaccagctggctactctcttctttaaaataaatcattttagaagacatcatcatacaggcatttatcacttactggctctgtttaccaagcaggacactgattgcctgaaagaatgaacctaagacccagagttgccagtggaagtcttctaggcactaggagaacccaagttagctttgttattaataacaacagcaactatgggaatgagcataaaggaaattatataatactgtccattattttatattgttaaaaataagcagaagacaaaatccatctaggtatttattgacacttgctctaaagaattcagatattcaagtaaatatgttcagcaattttgtgtattggctaaacgttctaatgacagatagcatgtgaatgggtttgatacacattcttatttcaagctgtaactgttcttatagaaatttttcatctgtgttgagaaactataaaagtgaaaagatagcattcagtttcagagtttgtgatgcacaaatatttctctggagtctctttaaccaacttttcttatatatagattattttgtctaaaacaaattaaaaacacaaagactatattcattggaaatcctgcttttatgtgcaatgaaaaatatgttagacattaatgagctggctggagcagcctcatatttatttttaatctaatgggttatatttgtgtggacataacctatgcaaaaaatcagatatttaagtgctaaaattgtggctatattgaattctaaggttattaaagatgaatacttcacgatcaaatatgagagttagtttaccaaaatataaaaagagctaatgacagcatcttctttcttgatgtactttggacatgtatttataatatgaattacatataatatgaatatatgtctcataaatgattatgtcaaatttataaagatttgaaaaataaaattgttagagcataaggagaaagcataatttgtaagtgtctgcatctagttgtggtttttactaatttctcatattatctaatattacaccaatgacaatcagaagtcatctgacctaaatttttaatatctgatacttataatctaccttagaatatgtggaggtcacttctggatagtcatatctactcactgagttaaattgaggaatcctttgtttttctgcttacataacgaattatcttagcaattctagagaaaagtttatgtacttgaaattaggaagtggtcaagcccttattatagaatttttattacttataatattttacaaatgttaaaaatcggcacagtggttcatgcctgtaatcctagcagtttggaaggcagaggtgggaggatcgcttgagagcagcagtttgagaccagcctgggcaacaaagtgagactccatttctaccaaaaacaattaaaaattcactgagcatggtggtgcatatcagcagtcctgtagccccagctactgggaaagctgagcttggagcagtgcttgagcccaggagtttgaggctgcagttagctatgattgcaccactgcactccagcctgggcgatagtgtgaaaccctgtacatatatatacacacacattatggaccacatatgctcaaaaggccactcaaaaagcagagtatcgaatctagaataagggggtttgtgcgtctttatcgatcataatcataattatttcactagcctgggagatcaggaattaaatttagaagcttggaagtaagctttgagtcttttccaaacatccccatgaacataggtttgtggaatgaaaatattattcttcttcctgaaaagaattccccagccattaattagtcccagtgttgtttctctttgagaaaaaattatctcagtcatttataaccaaaaacaatacccagagagaaattcaataacagtatacattaaatcagtgattccctagtcacaaataaataattctggttccgtatctagaaagtgaaaccattgcccagaacatttcacctcccattgtccatttgcggtctgcatcctgccaaagttacaggatttgggtgtgagaatttttagaatccaaagaggtatttacatattctgtagctcattgtagcagaacatttttctatctctctaaagattatgtacacaatctttaagagcattttggaaagagcagggacctcaagctcacatgtatttttcattaccttccagctgctagttcttagattgtcagaattgggataataacccgaagactatcactttgtgttttactaaaagggaagattgggttgccaccataatccctaattgaggccgaattagaataaacggctgttaagctctccagcataattgtgaatggtgtgtgtttgacattctctaagatataaattagaataaaaagaacattttcagagtcatggagtagctttgcattaatgatggcctccctcgcactgctgacagtctgcattattcatagtgtcattatcaggactattcagtgctgaatgatttgttcgcccagaaattgtatgacctgaccagatgagtaatatctgtagtttgtatttatccttatgactgcttacttgggtatggcttcttttatctctgttgtgagcttacttactgctgctcagcgggatgtaccatcagtgacagaagctttattcatttacagatccacagtgcggcatcacagtattaaatcctgcaaatgtggggaaaactcaaaggctttaatcatcggactggcaattgtcattgtactgctgccatatgtcagcgctgaagttaagtttcatgtctgtgcgctgtaaggaaggcatgtggccatgtgttgcctgcttgtttgtttaagatagagtcttccccgccactggaataactttgccattcaaatccctttcatctgcacagaatgaactaaccagagtcctacaatgaaatgtgaatgtgtcctttcagaactgattggtccatttcataactcctttcttattctaattaaaccagctcaggagagaactgtgttttagcatcttgggcttcggaatgacagggaatggcaggaaagaatcagaggatgtagaaagctctctgctgtgaaagcaaggtttcaaggtctagaggatttttcctcccagcaaagagatcatcttttgaaatcgtcgccatccgttcccctctacacacaccaatttcggttttataacaccccttgctgtgcatctcttggcaggaaagttgcccatcttgcagagtcttgcatgaataattcatttatatgtcatgctgactcttgaaagcctggattacagctttggaggaaatgcttaataggattcttccaaacaatccaaaatatagctcagagttctatgagttctatctcttagaaagcctcggtgcaataaaagaattaatgtgctggaagcccaaacacactcgaggccattcaacctgcgttgagctaaagtgtaacctaataatgaaggttagtattttagattagggtttctgtttctcagagacaggattcttaagtacaggccttgagttcaatacactggcacaattactttttgttagatcttgaggttttggatttttttttttttaacatcaaaggaccttggagaaccaggcagacaagcagctgagagaagtattgagttagatgagggcaaacaaactctgcatatatcaggtcgcatgatcgcctgccgttactcaatgatgctgttctttaaacagtggtcctgctatcagtcaagctggaaaatttaaagatcttctgtagactcagtatctcacctcttttagtccctgtctcagtaattttattgtatctactcacctttacttcctcttccgttttccacaaagccttttttgtcctcccttcaacacttgcctgtaacaaagtctttaaaatatatttacattacccatttaaggatcgattgcctaaattctaacccactttcactctcccaggatggtttgcgtcttaagccaagaagaaagtcatagattaaaagagtctattgattctactgaggcttattctttgcttgtttaataactttgaaaatgacaaaaataatgtgcttgttgtacataacaaaatagttaaactaaaagaaagaaaattttaaaaataataataaccaataacaacttgacattgtggcatattaatccatattcatgtttatatctagatgtggatccatctgtatgtctatagattcatatatccatgtatgtaactttacaaaggtaggacaatctatagcagaattttaaatagcagttgaattccagcagaggatctattcctttggtttgctctatctaggttgctgggttttaaactttttcagagtcttttgcattagtggaaggaatttggattggatatcttccttttttgccctcgagatctataattaccttttaaaattccgctctgtgccttgtcaggctaactttttagggttgtatctgtgggctttcttaccctctggcccccgattgagttcagccaatgagagaatcaacaggagcccatcaggaaggtagagtgagattagggtatttattcacccagtttcctttcttgggaaagggagttaatagcacacaactctttctcctgctgagttttagtagccaacccctcccctctctacttcaggcctggggtagtaacttcttattttagttattattgctgcaaagcaaactatcccaaaacttagtaacttacaactacaattgtttatttgccacagaactggcaatttttgcttggtcaggaaggtttatttttgcttttcactgcttcagctggagtggattaacttggggatataagatctatttccaggaaggttccctcacatgctggcaagttagtgctgactgttggcttggagttcaacttggactgaggaccaggggcttaggttcttcttcacatgagcttctctaaagcttcttggacttcctcacagtacagtgtctaggttccaacaacaatcttccgaaagaaaaccaggcgtatacactgcatcacttttatgatacaaccatggatcattctgcatcattttctactgtaatcacaaatgctcatagattcaaaggaatgaaatagagacatcacctttcaatggcagaataccaagtgaaactaaaaagagcatgtgggatgagaaatattagaaataaggcaatttatctgatggcttcttacttattagccacagagtactgtactacctttgggtagtttacttttgtaaacaatctctgtgttcaattatactcaaactaccaaatatgagtatgccatatttttttgctgggaccctgcttaatacaaaattgagagtaaataatagcagggaaggtaaaggaggagggtgccatttagcaaggtgtcaggaactagcctaaatatctactacagcaccatctttatctttaatacaaatattttgatatcacataagttttcattggaagaaagtctctttctgttaaaagaatattttaaaataccactgtttatgtccttgagcatcatgatatcagttttaaaagttgtttcctgcctactgtactaactcctaatcaaaactcttacaagtttgtgcttcttgccagggaaattcattttttcttcttggttaattacaagatatgtacaaagaacatacaatgttcagtgcaccttcagatgtgttaacgacacattatcaacactagatcatctgactcatccatattgacagtcaaggtatcattaacctcaaacttgaatgatctattcaaacagtggcttcatgcaaaaatagtttttaaaaaaatatttctataagtttttttcttccctttctctactgcacatctcttctcagatgaagccctttaggtacttattgaacctacagaaggaaataagatggcaggagttagtatatattctatttgtcagtacaagtgaaatagaatggggctatgtacttttcagaggatggaactgaattcccttggaaaataaaaagagaaaatttcagtattttggctagaggaatataagttaaagataatacctcttttctactttccttgtgacctgtaggaggttttccctatgtgaaactgaaagtggtagaattggtaaagatactgcagcagaaataaatgaagagatgcaggaataagtcaccgaaaaatttaaacctcaagtaatggtgcgtgcctttgtctaactattttaaatcagactcttgaaaaagagtcataataaattataataaagaagaacaatctacataatactcccattttacaaaaacaattttatcacaactataaatattctggcttgaaatatctggtactttccccacattgtcccttgtgatgttagagctgccccttaggtcattagatcagtcagggaccaagcaaaagacagaaatcacacacagttttattaacagagaatgtcctatgaaaaattgtaaactacgtgtaaagttgttaacttggcaatcgaaaaggcaaaaggggaaactaaggtatcatagacagatgacaaatgtgagaagcaacggacactcctagggctggggaaacagagggaataggttggaattttcagaaccttgaagcttggaagaggaggcctatagaacgaacagacaaagttctgagccaggactctgcttagctggcctagtgtctcagctcaccagaggagcctgccaaggtctggatatagacttctgacagggggatcctaaacagctggtgctaatatttccaagaaggacattacgaggttcgttctgcaggcactgagacacctgtacaacagcaacacagctgctttgagggtgaatatagtaatgtaggttagtacctcatagatacatttttaatatatattcagtacaaactttatatgtattttttatcatctgttatctatctgtctaccaacctatctattaacctatcttcctacctatataatcaatttgtcccattttcgtgatgctgaccagtaaatagttcaggagtttctgctgtgctttttctttaggttccgctcctagtgattgctataataggaaacattatgagttttgactcatttggcaagcttgcagtttcttccataaacagcctttttattctgcctaaatcaagcagatgcaaaggagatggaaaagctgcatgtattgatcatctatggtgtactagccaactgagctcggtgcttttcaaaaattatctcatatggttcttgccataatccaattatgcagatatttttgttctcacttctcattttactagtgagaaaactgaagttataaaacgtatcagaagatacacataaaacatatgaagtgggcaggatttgaagctagaactacctccttcaaaaagatttaaatcctcctgcccccaccaactttgaaaccactgctagcccatatggtgtcttgtgctaattttaaaaaaaatgtgcttactaatttaaaaaaaaatgccttctccaaggctgacaaaaccccatgggtacacaacctggcaagaggattaaatgtttgtgtgttagaaaaaggcatttctacttctgggtagatgcaactctgagtcaggtcacacagcttggagacctgagcgggggtttgatttgcatcttctttcacatcctgggtcgggcacccttgtgaacagcacagtctatacaactgaataccatggtctttttcaacatcactttcgtcaaaatattgttcctgtttaagatctctctttcattcagatttcagcattaagaggacaacatgcctttctgccctaaaatgctttgttgttctcacttcacttttatataataatgctaattatgtagtaaattagtgaccttttgctgcaaaacaaatgatctcaaaacttagcagccgaataagaacaaatatttgttatctcacataaattcttagggtcagaaatccaggagtcactttgctgggtggttctgctttgggacctctcatgagatggcaatcaagctgtcagcccggcatcagccatttgaagttttccgcagctgtggaatcttcctttaagctcattcacagggctactggaaggaggcttcagttcctcaccacactggcatctccacagagctgcttatcacatggcttcccccagaaagagtggctgaagagaagaagaaaaataccagtcacagtggaagctgaagggacttttgtaacttcacctcagaaatgaagtatcatttttttctgtggtaatttttttctttttctttttttgagatggagtctcactctgtcacccaggctggagtgcagtggcacaatcttggctcacggcaacctctgcctcctgggttcaagcgattctcctgcctcagcctcttgagtagctggtactacaggcgtgcacaaccatgcccagctttttgtttgtttgttttgtatttctactagagatggggtttcaccatattggccaggctggtctcgaacttctgaccttgtgatccacctgcctcagcctcccaaagtgctgggattataggcgtgagccaacgcgccgggcctttatctgctgtattttattggtcccacagaacaacattgtacaacgtacaaatgattgggagtcatcttagagggtagcaaatatagttaagactatggtctcattatatgtgccaacatcctgaggagataaaatggctgatactcaggtgatcctcagtggtacaactgttggctggcatttattttggtcaaatgagtgtttttcctgatttttctatgctcatgcccaatcagttgttaaatattttaataattattcctggagatagatatggttgttatcatcagcttgcagacgttgaatgtgaggtttctagacttcaatttcctccacaaataaatgctagaaccgaccttggaacccccaatcttttaattactatgttattaccttctttagtatattcaattttaacttcaattcatcacttctagaagtaagctggcaccacactaataccaaacatgtttctacatgaataaatttccataacatattaaatataaaagcctcttttaaagctagcttgatgttaaaaatcaaaggaagagattttatcattaggcaggtcagagactcatttcaccctgtgttcaaagagcagagcccatgtctcagataaagagcttatctaattttgaggaagacattctatattactgttttctttctagctaatataacatttggatttgagttttaaggggataaccctctccccaaatatttaagcatgtcagttccataggagtgcatttagggagaccaagtgggagatcctattatttgcatactccgccaacaacagaaagactgagttctgtaattatgaaaattatcggttaaaaccggttgacaggaaaaaatgacaacttggctgattttttaaaatttttaaatagatactgggcatgttatataagtgctgcctgaaggctgggtttgggtattttatcaaaaagtagcaaataataacaaatgtactttgtgaaaaaataattagtggatgtgattattttattttcgaaatataaatttatgcataagaagaataaatgcaaggtattagtagcaaccaatttacttcttatacaatccttatttcaggcaacatttataaaggccaactgaaattgaagctaaggcaaatgcccagatataagctcaggccaaaatccccaaatttgcagttatcaatatatcctcaatatatcaatggctccttggctacagggtaatgtaaactaagacaaaataaatctggtttgcacaagctttggatattttattagccatgtggcatcttccaacctatggaaattaagctatggccaaggccaagtctggctaaaaaaaaaaacaggcaatcacacaattttaacaagctcacatgttttaacgtaacctcaaatctattttcatttttttccatttcctgcccaataacagctcccatactgaaatgcagggactgaagccttctttttttccccccactggagaaatcttatctaactctattaggccataaataaacactaagacccatgctaaacctcaaaaatcctaaacaaatatgcaatatattcttcatatgctcacctatttcattcttataatggctttccctggatccatcgtccagatgcttactttgtgacaaaagtattttgattcaattatctgtgaagggaaatatcaaagaaaaaccatcataaagatatctggcctcttaaaactatgttgcctttaggagctcatgttagaagcgtaagagctgaagttttctgtctgaattcaatttcaattagattttaatatcagacctccctctgattattaatattctaccacccaattttcaaaaatgtaatttgtcatgcaataaccttgctggctctgtatttccatcatcacatttgccctcactccacattctatatggtctgtgtgaataagctcttaatcaaaattttattctattcttgagagtgtaactttcccaaactaagtttgtaaaagtgaaatctttttcactcaagctttgtaaattacaatcttcttaacatcaatggtttaatgtgttctgagaatgaggaaaaaatagggagggaagtttgcgtgttttaataattctccctttgcttcttctaatgaagattaaagtttatatgaaatttaatgagacatttgtctatcagaggtaaaatctatgcagtatctcctggacaacacataaaatgggcctctttaaaggaaaaaaggagttcttcatatttaaagtatcatataatagtaagaaaaaaataaatctactaatcactgatggaatagctatggtatggtatgttaccacttcataaattttgactatccttaaagcagttgaattaacccagtctaaatgcaaataggttttatttatttatttatttacttattcatgcatttatttatttaaggccaacttcagtttctagtagacactaataatgctgtaatgaggattgtgagactatgtgaagtcattggggaagattatcatgatcaattaatgatgtctgtcatgagtttgccaaagggaagttgtaggttatacatatatgcaagatattttgcatccctggtctatgtgaagtagaacaagactgatggtattagtccattcttcactgcaataaagacatacctgagactgggtaatttatggagaaaagacgtttaattggctcacagttccacatgctgtacaggaagcatggctggggaggcctcaggaaaattacaatcatggcagaaggcaaaggggaaacaggagtgttttacatggctggaacaggaggaagagagtgaagggggaagtgttacacacttttaaacaaccacatcacttgagaactcactcactaccatgagaatagcaagggaaaaatctgcccccattatccaatcacctctcaagtctctcccccaacattgggaattacaattcaacacaaaatttgggtggggacagagagctaagccacatccctgataaaagttttctattatttacctgttatactttaggaaaattttcgcatacttttggaattagagcttcaagggctgaggtttgggaatgcaaactttcaaaaatttcgccaattgattctaacaaggagccaagcttaggagccattgttttaaggatcagatttatatcaagcttattttttaatatttaaaaaagtcttctggatacatagaagttttatatacttacggggtacatgagatgttttaatgcaagcatgcaatgtgtaataatcacatcatggagaatgaggaattcatcccctgaagcattttcaaacatatttttcagttcagagctaagtggtaagcaatgagtgagtgtgtgcttgcgtgtggcaggcaggagggggcagtataggaaagaaacaatcgaattcttgtggaaaaaggactgctttatttctttgcaatcgttttgcatgtgggtttttattattacggagaccaacttcaaaggggaataaaaaatagatatagactagtccaggagaataagaaagaaaaaggaaggagagtataatattcatgtagggtcataggtctttctgtttctctgaaatttacattacagggttgcaatggttcacttgccttaggtacacatcagttaagtctcagaggaggtagagaactggggcaattatttgcaaattcattgacttagttgatcattgcttcaagtttctatttcaatcacaccatggagattgaactagaattaatttcctggttaagtgaccctaagaagtcatgccctgctctcttctaattccacaccattttactgcagatcatggcagctcatacatacaaagatacataaatgaatatctaatctttttagagacagggtctcactatgttgcccagggtggacttgaactcctggcctcaagtgatcttcttgcttcagcttcccaagtgctgagattataggtgtgagccacctgggccagcccgaaatttttcacaaacatgtttgtgtatgtgtgtatgtgtgtgtgtgtgtgtgtgtgtgtgtgtatgggtgaattggtgtgggtgtatgtatatacttatctactgaattctcttccccgtcccccttctccttttcctcctttccatctctctccctctttcacacacatacacacagacacacacacacgtgccctatgtagctatttatgtgaaggcattctaacaaaggaaaaacttttcaaaagtccacagaaattaaagcttctcaagatgcatcacgatctaacgaataaaaataacaatgttttgcaacatgcaaaatcacaacatattgcaaaagataattgaaattcctacatatgcctaggatattaatatttttccctgcttttttgtaattagattgatgtgcgtaattaaaaatctgctccccacatgtgcttaagaatgccaggtttttcctgagtcatattgtcaactccaatactaggtttgaatgtgtcttctatcccggtggtatatacacgtgtgatattttagcacccctgcaaggtgctggtgtgctgagaatatcagcacagatgttataggatgctgttattcagaaataaattattcatttcctgggcactttcagttttatgttgacaatagtagccattacaatccaatctgatttacattctcagcatttacctttcaaactgataggcctctgaaacaataaacgttttggaagtttagacattattttcagtctggttttctagatgcagaaactgagatacggatttgaatgtacttgatgtatcagggagtgtgctgaagagataaggactgaggaaagacaagcaagagttggtccactttgaggcaagggggtcaatatttatacccccaaggtattagtttgatggggttgtgatatggtttggatctgtgttctgcccaaatctcatgttgatatgtaatccccaatgctggggttgggtcctggtgggaggtaattggatcaagggggccatttcctattaatggtttagcaccattctgcaagtgctgttctcatgatagagttgtcatgagatctacttattttaaaatgtgaagcacctcccccgaccccttgttacatttctggtcatgtaagacatgcttgcttctccttcatcttctgcggtgattgtaagtttcctgaggcctccacagagactgatgctgccaagcttcctgtacagcctgcagaactgtgagccaattaaacctcttttctttataaattacccaatttcaggtgtttctttagaaaaatgtgagaataaactgatacggaatattggtaccaagaagcagggcactgctataaggatacctgaaaatgtggaagcagctttggaattgagaaagcagcagaagttggaagagtgtggagggttcagaagaagagagaatggtaaggaaaatgttggaacttcctagaggcttgttgaatgatcgtgaccaaaatgctgatagtaatatggacaatgaagtccaagttgatgaagtgtcagatggaaatgagttacttattgggaactgaagtaaaggtcacttttgttatgcattagcaaagaggttggctgcattgtccagcctggtcatgtgattgaagagaaaagccccttttcaggagagaaattcaagcaggctgcagaaatttgcataagtaaaaaggagccaagtgctaatatccaagacatggggaaaagactccaaaggcatttcagacacctttgcagcagcccttccaatcacaggcccagaggtctaggagggaaaaatggttttctgggtgaggcccagggccctgccaccctgcgcagccttgggacactgcctcctacctcccagctgctccagctccagccatggttcaagggggcccaattatagcttcagtgggtataagccataagccttggcagcttcctatggtgttaagctcatgggtgcacagagtgcaagagttcaggctcaggagcctctgcctagatttcagagaacatatggaaaagcctgaatgtccaggtggaagcctgttgctggggtggagccttcatggagaacctttaatagggcagtgcaaagcagaagtgtagggttggagcccacacacagagtccccactggagcactgtctagttgagctgtgagaagaggaccaccatcctccaggccctagaattgtagattcaacaacagcttgcactgtgcacctggaaaagccacaggcattcagtgccagcttgtgaaagcagccaaaggggtttgtaacctacaaagccacaagggtggagctgcccaaggcattgttatcccactccttgtaccagtgtgccgtggatgtgagatatagaatcagaggttaatatttgggagctttaagatttaatggctgccctgctgcgtttgaggtttgcacagggcctgtagcctttcttttggttaatttctccattttgaaataggagtaactacccaatagttgtacccccattgtatcttgaagtacctaacttgtttttgattttacaagttcataggcagaagggactagccttgtctcgaataaaactttggactgtggacttttgagttaatgctggaatgagttaagactttgggggactgttggaaaggcatgattgcgttttgaaatgtgagaaggatgagatttggaagggaccggggtagaatgatataggtttggtctgtctccctgccaaaatctcatgttgaaatgtaatcctccatcccggatgtggggtgtggtaaaaggtgattggcttatgggagctctttctcattaatgatttagcaccagccgctagtgctgttctcgtgatagagttctcacgagatctggttgtttaaaagtgtgtagtaccacctccctccttcttgctcctgctccagccatgtaagaggtgcctgcttcccctttgtcttctcccatgatggtaagtttcctgaggtctcctcagaagctgatgctgctatgcttcctatatattctgcagaattgtgagccagttaaacctttttctttataaattacccagtcttaggtatttctttctttctttttttttctttgagacagcatctcacactgtcgcctgggatggagtggagtgcaatggcgtgatctcggctcactgcaacctttgcctcccgagttcaagagattcttctgcttcagcctcctgagtagctcctgagtacaggagcctgccaccacacccagctaattttttttgtatttttagtagagacggggtttcactatgttggccaggctggtctctaactgctgacctcgtgatccactcatcttggcctcccaaagtgttgggattacaggcgtgagccactgagcccagccaggtatttctttacagcagtggaagaacagactaatacaggctgtcttagcaaaatactagactgggtggcttcagtaacaaaaatttattgtctcatacttctggaggctggacatccaagatcaagatgctagtggagttttttttttctgagggccataaggaaaagaaccattatcagacctctctccttggcttgcaggtggccacctgcttgctgccccttcatttggtctttcctctgtctgcatgccctttatggctctttttgtgtgcaaatttcctcttcttagaaggacacaagacaggctggatttgggccctgctaacaacctcatcttaatgtaatcacctgtttaaatgtgctatctccaaacatagtcacattctgaggtacttggggttagggcttcagtgtatgaattttgggtgaacacaattcagcttgtaatcctcatcaatccaatctgtcagtcactggctataggcaacatctagggaagagggtgaggagtaacatttccagtgtccctgagaagtcacttggagcagtgggaggatagatagaggggttactgaataaaggtgatctggtagggcaacccacagtgccaactgcagaaattattatatgccagtggaagaatcatgaagttcataaacgtggaatggagaactttatttctcataaagggttgcagcctctgggctggccactacacaggctggaaagtatcgcctctggaagaagccaagttcaaacactttgaggcaggggcaaaaggaacagaagtttatgctgagcagttgactaagtatccatattctataaactaaaggaggagtcatgaatatttatgaaaggagaaaccatgcccatgagcaattgagcttcatgcctcttcatgaattgcatagaaaaaagcatggctgtgctggcatgatgagggtggatgttttggccctctgatgtcaaatggtgaagcagaggacacgaaaacctttactgcacatcctccatgagttggtcaaaagcagtccagaggtggtggtcatttttttagaaaggggtgcattgtaaaactagtgagctgtcatgtcaaaactgcaaagctggagggggagtccagtcgtggcctcagatgactgattaagggaaataatggaatgaatcagctgtttcttgttttccagaacttgtttctgcttactcctcaggaaaaaattctggttaaaggttaataagggaggggaggactgaggcacatctgacctcttatcccatcatggctgggagctcagttttccctttggtccctttggctcagaaggggcccattcagtcagtcaacgggcttaggattttatttttatttctcaataaatagaagtaactaatatttcatgatcccttaataattaggtatttcatcaaatttaggaacccattaacaataacacacactattattttaaggactgtaagaaaagaaaaccatgccacaagatggcaatctaataggaaacctccagaaaagtgggacacaaaagaattaaattctcaatgtcaagaaaaatgagtaatgaaaccaccatgcagaaaggcagtaagaaacattcatgtttatatattggcacacgatagaagaaagaaaaaaataactcccttaaaaatttggaccttaagctcttactaacatgaatttttgactttaattcacactactcaggtggtccaaaaccctaagcagacaatttaattaaaagtgctctcaggtatgcagtgcccccaaataattggaggagcaaataccaatgtgaccaaacggtgaagatgcactgattagaaaacgcttcctccgcagatgtcaaatgatgataaatagtgatgataacaaggatagacaaaattttgtataatctgaggctttttctttagtgttggcaaactgcagcctgtgggctggctgctgctccttgttataaataaagttttattggaagacaatcatgccattcatttctatacaatctatggctacttttgtgatataacagcacagttaaatagttgccacagagaccatatgacctacaaaactggcaagaattattatctgaccctttacaaaaaaagtttgctgaacccctgatgaatttccacctattacattatttcattttaaccacaatcttatgtggtagataacattatatccccattttataggccgggaaacagggaccaagaggttaaatgacttacccaatgtcacatactagtaaatagcataagaaaaatttgattataggtatgtcattaacttctagtggttaattatgtaagaggggaaggtatccaaagaaaatgggctgcctgatagtaggcgttcaatagatagtttgttgtatgaataaatgcatgaattaatggatatagtcaagatgtggcagaaccaggattttaacccaggccactctgaatccaaattccaatatctcttaaaaacaagatataaaagtgtaattaaccgcagagacagagactgccttagcctctacccttaattaacttgacagagtaacccacacctttttttctgataaaaacatgctgactcatgcatccactagggtactcacaaatacttttgttcccagcagatgtgctctttgaatcccattttaatctgcatttttattaactgacctactgttgtcctgattacattgaagaagaggtcatccattgtaccagatacaggactttctgtgagttaatagatccaaaggcagggaaataattttccttaacaaattatccatttgtttcccaatatttagaagaaaagtcattatttttgttaacaagtaaaataaaattagttaaaagccctatgttaattgaatgctcattataaagttaaaaataatttgagtgaagtatttatatctgtgcttataaatatttcttttttttttttttttttgagacagagtcttgctctgtcgcccaggctggagtgcagtggtgtgatctcggctcactgcaagctccgccccctgggttcacgccagtgtcctgccttagcctcccgagtagctgggtctgcaggcgaccgccacctctccccgctaattttttttttttttttgtatttttagtagagacggggtttcaccatgttagccaggatggtctcgatctcctgacctcgtgatctgcccgcctcggcctcccaaagtgctgggattacaggcgtgagccaccttgcccggcctgtgcttataaatatttctataaaatattcagcttaaaattgttgtaaaaagattattaaaataggaaaataattcaatagttaatagaaaaaaggaatatttttcattatgaaaaactcttttttaatttaagcaagaaaatattaacctactggtgatagtagaaacaagatggcaggttcttttctcaagaggagctcgctgtgtagtaggcgagcctgtgttgaacccaagcagatctggctctagagtctctgcttttaactactatattctactgccttttcctgagaaatgccattttgcacaaagatctctgcaaattgcttaaaaagctttctattggagcagagtggaggagatatttgaaatgagttttgaatggctcatgggagcttagcaagagaatgaggaagaaagaaagaaggtgagatgagatttaaaaaataaaaaattgtgctgaggccagaggcatgaaacaacatattagggtcagagagtttaaagtggtttggtaatggtagagggtagggtgaatgttgggacatggtgaaggatgaaacaaataaacaaagtaataataacatgccctagtttgactttcagccaatgaacagcaaggagtcactgaagaatttaaacaacagaatgagaaactcagatttttattattgaaaattgtcattctggcagtagcacgtgaaatgacttggaatggggaaggcagggatctctctgaaccttccttaacagtggtctttgctgacctttcctctcctgcctattctttacataccaccatggcccaagagccaggccctggcctcttcttgtcactttctacaattccttggccaatctcatccattcccatgattcacgcatctgtacaagtgagctggatccctctcttgagaaatagtctgatggtacacattcacagcagcttggagcagaggaatctcaaagtccacatatccaaggaacagaagaagctcaactctgtggattcagatctgactgacaaccctccaactcataccgtgaactgaaattagtaattgaccttaccatcccatctaataggcaagccaggaaatcagaggccctcctaaatttctctctttctctcaccacccattgcattttatcccatcaatttcaaattaatacttgtattctgttaactcaacctataatagtcccatccctccctttcagtgtggaacctgaagagcttttaaactcttatatagatgttagaactccaatgcccagagagtctgagttaaacggtctggcatgaggctcaggactggtatctcttaaatgttttttaggtgttttggatgtgcagctatgagtgagaatcattgctctcagccaaataaactgttagtgatttgtccattgcttccacctccatgttctctctcattctcagcccatggcatgtccttcagccatgttaaaggcatggtaagttcttgaatatgccgatttattccaagcctccctgctttgacttatgctattctctatgtctgcatttcctaccattatccttctctatacacttgagccttctctcctcaagtagaactgattattccttcattttgcctcagcccctgaggtccttcctcatattttagagtatctataacttcattgcctttgttctttacctatctatcttccccgaccctggaaatcactctctgagttgagcgatcatccagtttcattcttagaaatatttcagaaccttacatatagaacagactctctcaaatggtatgctattgatactttgggctgagaaatcctctgttgtagggatccatcctacagcaggatgtttagcaacatccctcgtctctacccactagatgataagtagcaaccccttcccacttgtgataatcaaaaagtggcacatgtctatagtcccagctactcaggaagctgagacagaaggagctcttgaagttggccagcctgtgcaacacagcacgatcctgtaaaaaaatgaaaaaacaaaaacaaacaaacaaaaccaataacaacaaaaaaaaaacacctacaaacattgtccaactctggggtgggtgtgaggaggacaaaatcaaccctgctgaggacaactgagatgctaaaactgattggtggaggacatgtagaaagtgtggctgcttgttatgctgatggtttctttaaaacaagcctccctatgtagtcccctcttctgttgactcagggcttagccatgtgatttactttggtcaataggtcatcaacaaggacaatgcccacagaggcttgaaaaaagcttgttgtactagggattgcccctttggagctcagctaccatgtataaagcccaggctagtttcctcgaggatgagacaccacaagaaaagagagacacccataccacaaagagaaagaagcccaagtcttccaacattccagtgaggcctgctcccagtgtacctgctatatgaatatacccaggtgagaccagtagtagaatatcccagccaaaccacaggatcatgagaaacaataaatcattatctgtgactttatatttagaacactccatcatctcagcccaaaaacttattgaactgataataaatttcaaggaagtctcagtatacaaaataaatgtgcaaagatagcaatcattcctttacaccaacagtaggcaagcagagagccaaatcatgaatgaattcccattcacaaatgctacaaagagaataaaatacctaggaatacagctaacaagggatgtgaaggacctcttcaaggagaactacaaaccattgttcaaggaaataagagaggacacaaacaaatggaaaaacattccatcctcatggataggaagaatcagtatcgtgaaaatggccacacagcccaaaataatctatagattcaatgctcttcctatcaaactacctttaacattcttcacagaattagaacaaatctactttaaatttcatatggaatcaaagaagaccccatatagccaagacaatcctaaacaaaaagaatgaagctggaggcatcacactacctgatttcaaactatactacaaggctacagtaaccaaaacagcatggcactggtaccaaaacagacatatagaccaatggagcagaacggagacctcaaaaataacaccacacatctacaatcatctacaacttaacaaaaacaagcaatggggaaaggatctcctatttattaaatggtgctgggaaaactggctagccatatgcagaaaactgaaactggaccccttccttacaccttatacaaaaattaactcaagatgggttaaagaattaaatgtaaaacccaaaaccataaaaaccctagaagaaaacctaggcaataccattcaggacataggcatgggcaaagacttcatgacaaaatcgccaaaagcaattgcaacaaaagccaaaattgacaaatggaatctaattaaactaaagaacttctgcacaggaaaagaaactatcatcagagtgaacaggcaacctaaagaatgggaggaaacttttgcattctacccatctgacaaggtctaatatccataatttacaaggagtttaaacatatttacaagaaacaaacaaccccattcaaaaagtgggcaatggatatgaacagacacttctcaaaagaagacatttacatggccaacaaatatttgaaaaaaagctcaacatcactgatcatcagagaaatgcaaatcaaaaccacaatgagataccatctcatatcagtcagaatggcgattattaaaaagtcaggaaacaatagttgctggcaaggctgtggagaaataggaatgcttttacactgctggtgggagtgtaaattagttcaaccactgtggaagacagtatggtgactcctcaaggatctagaaccagaaataccatttgacccagcaatcccattactgggtatatacccaaaggaatataaatcattctactataaagacacatgcacacatatgtttattgcagcactgtttacaatagcaaagacatggaatgaacccaaatgccaattaatgatagactggataaagaaaaagtggtacatatacaccttggaatactatgcagccataaaaaggaatgagatcatggccttttcagggacatggatgaagctggaagccatcatcatcagcaaactgccacaggaacaagaaaccaaacacccatggtcttgctcataactgggagttgaacatctgtgaccagatggacacagagaggggaacagcacacaccagggcctgttggggatagggggtgaaaggaaggaacttagaggacaggtcattaggtgagcaaaccaccatggcacatgtatacctatgtaacaaacctgcacgttctgcacatgtatccctttttttattttttagaagaaataagagaaaatatcattgtctgaagccactaagttgtggtgtggtacattatgtagtaatacagaatatggaggtcattttaaaagtgcagtgaaaggaactgagaatctgaactagggcagtggtggtgggaatagaaagtggtgtggaatttagtttaatgttttctgtactctgctgagcaatctactaagtaccctgcaggattcacatttatcaataattgatgatttatacttgtacactttttttaaagatttgaaaacctttattacctcagtaattattttcttaagtgtttgctatgcattaggcactttacaagcattagttcatttaatcctcgtaacaacactatgaagtgagtcatactatcagtccattttataaatgagggaaccaaggcttataaaattaaatacttgaccccatcaaatagctagtaagtggtgaaaccaggattcagactaagctctgtctgactcctgaagaattgcttttaaatattcttctacattttcaaaaaagtgtttggtgtaagatctttatttgatctttctgggagtagagaaaagctatttgccattcttttcattctcaacaatccctttcccaggctgaagtttcagtttaacagggagtatttttattgtgaataactgcaaggtcaatttgtggtacattttcacttcctgaatgatacaagtttcagggaaatggatgtgagggacatgaatttccagtctatattagcagccaccaaagattatttgctgtgaactgattagcccctcatctcccttctcttcttcaaaatctaaggaacgttctgtcttttccagcacttcgaggactttttgtgatttagaatgggaagcatggggcagagagaaagtcaacttgagtggacagagccagaggtgtgcttctgctgaaggtagggatttgaggggttagcaggaaggagaggtccctaagagggaataagttcacatatgaccttgctatatatcaaggttatagattcctttacttgctctatttacagctttcccaaatgttgctcacactatctgaagccacataaccaaggattataaactttcttgagaaagcattactaaacttccccagacttggcaaagtacacgcttagctgttcttatcgtgcctacagctgtggggagctttctttgaagagtctctcctccccatcaccaaatgcagtatcaggaaattccacctgagaaactattgttttttacacgtcatttgaaatatggcttctgagatttcaaattaaattaacagcagcctgcagtcttgactgcttctagaaaaaactgtgtataaaaagcccagccatcttttgatctaaaagttctgtatatatttaaatttcctagtatctcatgtttacattagaaatgcccatctgggtttgctgaatgaggaataattgtgtgtccatttgtttttctctgatttgtagttacttcactatctcaagataaaagaatattttacctcggtgagagaggactcaagtttttttgacaatgtcatttgtgatacagccaagggctttataactgactgtatacatctaagtggctatttaactgaaaagaaaataaatttggttcaatgcttgagtctatgctaatgtcgactgtgacagaactttcctttctttactctctaatccagcagagggcactgatcaaacatcagtggctttaaacctagacgccttgttcactgaatagtttatcagtgctattagataatttttctcttcaagccattatctaactggaagcaaactttggaaaatgatgtgtacattggccttggtaaatggtttatggatttaaaataataattttcaacacaactgcaccctgtattctctatatttttgccgttcagtacagcaaccacttgccatgaggggttactgagcacttgaaatgtgactagtttgaattgagatgtgctgttaggcatgcaatacacactggcttttaaagacttagtgccaaaaaaagaatgcaaaacgtctcactaggtttttgttgtttttgtttttttaattggtgaaaagttgaaatcatgttttggatacgttgggttaaatatacgatttaaataaattttagctgtttcttttcacttttttaacttttctactagaaaatttaaaatgacagatgttgcttgcattgtatttccactgtgaagcactgatctcactcttagaacacttcttttcttctctaagagtaagtgttttccaattatactgcctattttgcggtccaagcccctattcttgctttccctcaatgtttctcgtcttcccagatgaatccagaaaccacaggtccccagtggtaccttggcactgtgagagtcacctgaaaactacctttaaaaagtcaatggccaagccgggcgcggtggctcacacccgcaaccccagcactctgggaggccgaggcgggtggcttccctgagctcgggagttcgcagccagcctgggcaacacggccaaaccccgtcgctactaaaatgcaaaggaccagccgggcgcgatggcgggcgtctgtggtcccagccagcggcgaggctgaggcgcgggaactgcgtgaccccggaggcggaggtcgcagtgagcagaggccgccgcactccagcccgggcgacggagcggcgaggctgaggcgcgggaactgcgtgaccccggaggcggaagtcgcagtgagcagaggccgccgcactccagcccgggcgacggagcggcgaggctgaggcgcgggaactgcgtgaccccggaggcggaagtcgcagtgagcagaggccgccgcactccagcccgggcgacggagcggcgaggctgaggcgcgggaactgcgtgaccccggaggcggaggtcgcagtgagcagaggccgccgcactccagcccgggcgacggagcggcgaggctgaggcgcgggaactgcttgaccccggaggcggaggtcgcagtgagcagaggtcgccgcactccagcccgggcgacggagcggcgaggctgaggcgcgggaactgcgtgaccccggaggcggaggtcgcagtgagcagaggccgccgcactccagcccgggcgacggagcggcgaggctgaggcgcgggaactgcttgaccccggaggcggaggtcgcagtgagcagaggccgccgcactccagcccgggcgacggagcggcgaggctgaggcgcgggaactgcgtgaccccggaggcggaggtcgcagtgagcagaggccgccgcactccagcccgggcgacggagcggcgaggctgaggcgcgggaactgcgtgaccccggaggcggaggtcgcagtgagcagaggccgccgcactccagcgcgggcgacggagcgagactcctcgcgggcagcggggtagtgggggcgggggggggcgcggggcagggcttgggggaggccaaaggcgacctctgagctcttgtccttaccctgggagagtatggaactcagagaaatcatctgacccgggtaatgtatgacaacaagcaggaaagctttgcttgagaaaaaaaatgtcttgttttaaatgctgaggctttgggaccacagtttcatgatgaacaaacattcactgaaccccctaccttatgccagaggcttttccataattatctcctttaattgtcacaaaaaaactcggcaagtgtcagagttattgccatgctacagaagaaacatcgagacttagagaggtgggacagctttgccgagaccacactgaagagcgtggtaagtggcagaagagaccttaagagccagctttgttcagcctgcaggatgctctctccacctgcgactggcaggttaagaagaccctgggtctgagatggtgatcggcaggcagccagtgaataggctctgctcactatcgggtggtcactaaccatatccaggagccaaagcagggagctggtagcttgggagcagggacatcacttctgacagcaatgggatgctgaataaatcagttattgaactaaagaatagagaaagagagagagagagcatgtaacataaaagtctcctcttttgtgatcttaataagataaatgtttcattgttctcacctctgattggggcctattttcaacaacaaaagaactgctttggaactatgactattctgctgattagacaaactaggttcattagaaagatcaaacagaaaagttacagagaaaacagaatttaccagcatagttcagactcaggggcttaccacggtttcattttctccataagtggattcttgaaacagcaaagaattcttttctgtcatcacccctcatgttctctaaagtagaaactgggaatgcgttgctgtaattgtgttcatggcatctttgtaattttccaggccttaaatgagccagtccaaaagcaatactggttcaggcaaaatgaaacttagccttccaagaatacatatttggtaaaggctgagctgattttaatagctaatatttattgagtgctatttctgatggttatatgcagtatttcattaaatcctaattcatttttagacagtaacactgttattatccctattttaccaaaaaggaagctgaggctcagaaaggttacgtaatttgctataagtcatagaactcaccagtgtgaggattgtcaccactgacccttttactcaagagctttgacgcgtaaccattacaccatgctgtcttccttagagaacatcttgttatcatgaaaaaagttattttctttctctggcccgttaaaacaatacaaaaatctatatcaatggcatttgcaatgcaccagatacttttacccttttcattctttcactaacaaaaaattgatagcaaatgtaagcccatgtatttatgaaggcagttggttcctgctcacttcattttaccatttgctttcacttgaagaaaggaataactgagagcaacctttactgctataattggatttttgtcatcagatatggtttggttcaattgtatcttaggagaaataatacacatttggggtttagtttatagaatctattttctgtaaccttagaagtcttaaattttatctaggaatgcattatattcaacactttcaacttgcatgtaacctgctagggggaaaaaaaggctaatttaagaagatctttctaatcttgtcttccaaccttcacagtgaacatacccatctgaaatttgcattttttgtcatcttgaactttgcataaaacttctaaaaatgttcttatctatgaactgcaggaacctgaagaataattttgtctccaaaataattactggagcacttccatgttctttgtgttgttgagaaatttttttttttttaatgtatgcagtttttaaaaaaatctttgtttaaggccctaaatatcatacatctgggattcgatgaacaagagtttggggaaaaccatttattattattattatgcagctcatattataattttttaatttaacttttattttaagttcaggagtacatgtacaggtttgttatacaggtaaacatatgtcatggggttttgttgtaccaattattttgccaaccaggtattaagccctagtacctattagttattttgcctcatcctctccctcctctcaccttccagcctctgataggcctcagtgtgtgttgttcccctttatgtgtccatgtgttctcatcatttagctcccacttataagtgagaacatgtggtatttggttttctgttcctgtgtgagtttgctaaggataagggcctctagcatggagcttatattttaaagaaaactgatgagttggccccagttgtggaatgaagagttttcagcttgtgttgggaaccaaaaaggctgttaagtgtagttcaagagttaaaacaaggcagggtaatagaacattttaccgatggcttactagtttctagtaaaaatgaaactcatcccctaactgtggaaattcaacgtaactgtggagtctcataaaattatactgtgagctattatgacaaacccaaaaggaaaaaatatgcaatttaagaaacatattctgaatatactttttaagaaaaatctaaattctttaaaaatggtgtgacaatcagcagaaggaattatggtagattcttctagtaatagaaaatagtatttctattattaggcaacagacagttttgtggatttgtattatccatctcaagaattttcataaaagcctgattttcttttgctttttaaaaatgtcctatcctgactgaccctcttaaggtcagacttgaagaacaagcttcttacttgatactccttaagtgtctaaaacagtgtttataaactttcatctacatgtgaattaccagagtgcattgttaaaatgcaaatgctgattcaactgagatggggcctgagatttgccatttccagcaagcttgcctgggatgccctcactgctggcaggcagacttcactttgtgtggcgatgcaggggagccctgacaattccagccttgccttccctctttgttcctattcgatccatccacaaacctattggctctgccctcaaaatctatccagaatataatcacttctcacccaactgcatagctaagacctcaagccaagccaccatcattcccttcctaatctctgccttggcttcctaaatgacatctgtcattgactgttgcccttgaagaatatttttcacacgaacggcagagagatctttctccaaacataaattaaatcaaacctattccttattatttcctaattgtttcccagcccattaatacccaaacctaaactgtttgccatcaataagaccctcccttatctgacctgtttcctgttccaccttgtctgctacttttctctgattttcactccatttcagccagaccagctgacatgttattcctttaaaacaccatgtgcattcttacctcagggccttcgtatttgctcttccttctttctggaaagtacattctataaatctttgaatgactccttacctgatgccattcaggtctctattccaatatctgctcttgaaataaacctccccataccctgtttacaatactgccccagttattatggatgtgtagctgaaaaagtttagtggtttaaaacaaaaatatttattttgcttttcaatttgcagtctgagcagggcttggtgggaacagctcttttctgctccactcaactttggctgaggaaggtggctaaaaggctggggaatggaatcatctgaaggctcactcacccacaagcctgacacctggactgagaagactcaacatctggggctcctcaagcatctgtctgtgtctctatgtggcatcacgtcagggtctctttatcgtagttgcttcaggttagccagactccaggatcacaggtggagaggcagagaggagaggagaaagagacacagaaagaaaaagagagacagagtactaggtggaagccaaatggccatttgtgactcagctttggaagttactcatacagtatcacctctgctttcttcttgcctgccaagttctattagttggaggcaagtcactaaggatggcccacattcaaggaaaaaggaattaaattccaccttttggaggaggaatgccaaagaatttgaaaacattttgcaaaacccatcacatggtccaactgttcaaccaagattctgccttatttttcttcctagtgctgatcacgtggatctcttgtctgttcctcctactggaaatgttaagtcccatgagaggagggacttggtcttctttactgctgcttcaccagtgactcaaaactgctgggcaaagagtagacattcacaagtactggttgggtcaatttatttatttaatgaacctgttttctctgcagaactcagttcaattcctgcttaataatattactaatgaattaatatatgaaatcttcttagaataatgcagggccccgtggtctgtgctcagttaattctaggaactgtccctaataagagctaacatagatagtgtgtttagtatccactgagctcctcatgtaggttacttttttttaatctcccaggaaatccatgagatgatactgtgattacacccttacttcacatagctacttagtgactggaactcagaactgatcctgcctaattccaaagtacaagctctcattcttcctctatggtgcattttgatcatttatatgggcaaggtggaaagtaagtgattttggattaagacacagagccttatcctggctcttctatttcacctcttttagcctcagttttcccatttgtagaatggggatgataatgatatctatctgagagggctagtgtacagttcaaatgtgagctacatctgtgagtggcttgccaataatatagtgctaaaggaatatgttaaaataattggttgagaggccattaggctgaggcagctccagcactctgggttctatctaagcaagttgaaacctgattcactggaaatagtaacacaaaacttaagcttaaccagtcagaagctgccaaataagctctcaataggaactttccacttgaatgattcaaataaggccactgctccacttcaaccagtgaaatattttctttgccttgtttccacattcaccctgtaaaagcctgtaactcatactcctgttggtggaacccccaaccacctgtggtctggaattgcctgatttataaattgctgttagctcaaagaaactgtttgtattttaatgtgcttcagtttatcttttaacagtaaaatataatctttaatattttactatgtatcctaatcattgctatagaaatctgtatgcatattttattctaattttaagtttttggttcctagtataagattgactgtacttgtctatttcagtgtcttagacagaacaaggttttggtaatcatttcaggaattaacgggtaattccaacactcatggtgtgaagagtgcccctaaaattaagaaaaaatgcatattctttatatttatttgaaacaaattatctcaaattctttcagaagtgaatagatcaactgttaaaaagtagaaaaacaattggcttactctgcatggaatcatgaaagtgtgaagatggaaaagaacagaggcatagttcaaaatcctgataaatcacttaatagaaaggacaattttgtaaatgtttttattttaaactttcacttcctcacatgtaaaatgaagttgatagtactaacctcatatgttggattaaatggtataatgtaaatagatgtactttgcaatatgtaagttattgcataaatataaggcatcatcatctatttcttataagtctaggctaatttctacttatcttagaaaacgaatattaccctggggattcttcgaagaagtaactaaacatcattttagaaattcctgaaaacatgtattttaaaattataaaaatgaaatagtgaagcttattaatggaataaatgcttttgcttttcattgtaaagaaaattgttctgatatgaatatattgcccacaagtgctgtaatggaggccttgcaaatccttgatattttattctttcttaagtgtaccaggtaaaaataaggcatgccctgggatgaattctgcaaattttctcccaagtatcatcctccagctgattcccactcaaagatatttgattttgtttgggataatgtcttaatttgggcttctataacaaattaccatagactgggtggcttaaacaataaacatctatttctcacagtcgggaggctggaaagtataacatcaagggactggcagatccagcgtctggtgagggatgcttcctggtttgcaaatggccatcttctcattgtatcctcacatggcagagagtagagagagcaagagcaagctctggtgtcttcttttagaagggttctcttctcatggcctaatcacttctcaaaggccctacctcctaataccatcatattgtggggtaggatttcaacctatgaatttgggggatgagaatacaaacattcggtccatagcatgatcagccccaaaggccagtgtgtgatacattttcgttaattgtgcgtatcctagttttttttttttttgcaaaacacatgttttcctagtcatgcatagctggaatagaccttgtaataaaattttgtcagtgaagtgtaagtggaggtttgccaagggacttctgaggaggggacactttctgataagaaccacacttaagaaatctcaatagctatgctcctttccattccttcctcgttgagacatcaatgactctctaacatttgtaaccatgaggaatggactaagaaaatagaaatatctctttatgtaatggaatcctgatgtaattgagcctctcaataacccttgtactatctatctacctacttactatctttagtaaataataaaaattctgtgattaaggccactgtagttatttggttgctgttgtggttacttggagatgactgcatattaactgatatatgctatagtatctctctaggaaagagtaatcataaagcaagggatttctgtactgtgttaaaatagtttgattctagcaaaagttgaaataaagaaaaacatataatctctacaacaaaaaatattgctccataaaaatattttacatgaagactctgtgagtccctaaataacttcagaaattagaaattctaatttctctgagattttcttcattctttggccagacaaacagcatcccagagaacttctttttctcattaaaatatgaataaaatttcactagttaagtatggtatgaccaattaaaaataagaacaatgtgcagtgagctgagatcgtgccactgcactccagcctggggcaaagaacaagactctgtctcaaaaaaaaaaataaaataaaataaataaaataaaaacaatgaaaataacaattttcagattactgttcatcaaacatactaacttaccggttttgtactctggtcaatgctatttaaaaattccttcgttttgaaagatttttctccttcaagttctctgaagggactgaaagttcaaggcatctggatttaagagagttaaaaattggatggcaaagtgaccccaaaaaagttagaaacaagattaagattttgataacccaaattagggagttaggcatcatctttcataggagcaataatgagacattgcattatcttattcagggagagattttaatgtgatgaacatattaaaggaaccatgctggccacaggataaagagtcatctagatggggcgagatagggaaaagtgaccactcggttgttgtcataatttgggcaagatagtgataacctaaatgtggtactagaaagtgaactggcaacaagtgcaacaattacaggcattaaaaaaaaaggatatacaatcatcccttggtatccatggggattggttccagtaaccctgcagataacaaaatccaaggatactgaagtccctgatataaaatggtgtagtctttgcccataatgtatctctcttcgtgtgtttaaaatcatctctagactacttattatgcctaatgctatgtaaatgctatgtaaatagtttgtatactctattttttaaatttgcatttttattgttatattgctgttcttttatttttatttttcatatattgatctacagttggttgcatctgcagatgtggagacagtggacacagaatctgctgataatggagggctcactgtataagcaaacagacagaagtttgtgccatattagacatggacatagagggagtgggaatagctacaatgacagaaatacttggatttctggcttaagaaaactagacagaagtcagtggtactgttcactgggattgcttaactaggccaaatgctgcagagaaataaaattaaaatagaagggaacaggtatagaaggtcttggtatttatattaagaacttggtctacatgggggaagagtagaggggattccagatgtttgtggcttgaagagggactagacagtaagttgataggtaagtggaggcagatacatcttgaagatgtggagaaagagaggggcaaactgaaggaaaatggaaagttaaggctgaaagaaaactttggtttgaataggagagagccaagtaagtttcatggatccaacctgaacagttggttatcttcattctcttctcttacacatcaaatactaaaacaagcaaaaaacatcttctgttattttcctttcttttaggctcactctgtggcattgcagacaatacaaggaaagatggtttaaccttaggagaattgaatcccaggggcagcactgtgactcagaaaccaaaagggaccatttcttatttgaaatcagccatgcaacttcaccggttttacaatgactctagccacctcttccttagcagacacttccggggctactactgcttgttatctgggtcctttcccttttgaccacagatcctcctggaatctccagtgtgagccttcctttcctcctcctgtgtcttctttactttgacataaaccagttcagtttttgtttcactttctcttgttaaagacacatgcatttctaaaaataaagggtcaaatactttacctatagaaatgtatatcagctttggaagctgatggcatttgtggcactgatggctctgtgttcattaaaaaaaaaaagtatttccttttcttcctggtggttagctacctatccagccttttatgcaattaagggagatcatattatgcaatgtgccctgtggactgaaatgctatgtgtcaccttgcatggtcatgtgttttcacatatccttttttttctgctttcaggtggctggaatggctttaaccccaaggccgtatttggaagccacttgtttaaaattaaggagccagaagctagaaagagctcctgtctctgattcaccacctaggggagcactatctaactatcagaaatttttatcagcaggaaataaacttctattgtgttaagcctccaagattccagggtttatccattaaaaaacaaccaaaatactaacaaatagattattcattcatgatggtaacatttgccatacattgacttaataccaaacactgcataagtagtatatcatttaattgtcttatcagctgcatgaagtaggtatcattctccttattttatagataaggaaggagtctatgtttcacagtgttaaataaactggtcctgacagcccctgataacttcttaaaggctatgtagagtctcagagtttttacttaaaagattattatagaacaaagcacagggatgtttgcttcagcctcatagagaaagtaagttcctcattcattttaaatctgtatgtataaaacacttggagacagtgtaatcaatatataattatgtatagtattgcaattcataatacttgaaaaattatatgttctaacatgtatatgcaaggtcaaattctagagtatcttttaaaacaataaaaaaggaaaagattcctttttctaaaaataagtccaagatataggagtatgtcatctaataaaaactttccagatatagcttttacttgacataacctatttaaaatgtacaactcaaaaccaacctggtttgacctaagcgtatatgctcaagtatcgcacgcacgatcttgaatattcacattacggttcattgaaaaggcaatgggctttgcaacaaggttgacaacaaaaggaaaaatgatgaagaaaattgcctcacttatctgctacagtactcttgattgccaagtgtaatttcatggttcattataagagacggaaaagtttgaccattaacttgagtacttgtatatcctattgatacaaagaataagttgcttgaaacacacttggtttttaatgaagccactgtaattttgtgtttttaaagcatcatcaattttcatcagttttacccctgctggagttttatgcgggtaaaatagttaaaggtcgtcagacactgtgggacgtaaaacaactgtagaaaaatgaagatgttaaagtgacacaggggtgacatgagttattttctgagttaccacttgacatagtgtgagatttgactgggtaattgaggtaaatagcgttgctgttacagatgtcatatgatagatcagataggggtcagataacttaacaagtttaatcatcctttaacacaggggaacactgctccacatttctatggggaatgcacccatttaaagttatgtttctccattctagtaaatattcctaaactttaattccctaaaggacactccactgttcaaaaacactttaatagcttctcattatctagcacggcgttgttcaaaactgtagccgccaaccacatgtggactgtttaaattacactcagtgaaaattaaaattcagtttctctgtcacaatatgcaaatttcaagtgttcaacgccttcaagtggccagtggctactgtattagacaatgcaactctacacagtttccatcaactcagaatgttctatttgatagcttatatctagaactggactatccaacatggtagtcctggccacatatggagattgagtgcttgaaatgtggccaaacttgagatgtgccatccatgtaaattacatactagatttggaaaacatagttcaaaaagaatactgcaaaatagttcattaataattttctatgctacttacatgttgaacaatactttatatatacttttaaataagatacagtactaaatttaattttatctgttactttttaaacttttaaaacatgacaactagaaaatttaaatttatttatttattttgagatggagtctcgctctgtcacccaggctggagtgcagtggtgcgatctcagctcactgcaacctctgcctcccgggcacaagtcattctcccacctcagcctcccaagtagctgagattacaagtgcatgccacaacacctggataatttttgtatttttggtggagattgggtttcaccatgatgccctggctggtctcaaactcctgacctcaagtgatccgcccacctcagccttccaaagtgctggcattacaggtgtaagctaccatgtccagcttggaaaatttaaatttagttatgtggcttgcattatagttccattggacaacgctgacccataatgacaaagtctatatgataaaggcctgaaaggacatacccgtagtgcaacaaagtggggcttcttaacttgctgtccactggaggaactatgggggtgctcgccaagcagaggaagagacacagttacagtaggggtctgtggaagagcaaaatttaagagaaacttaaatgatgtagtattttggtagaatcaagcaaaggagggagggctgtttatagaggaattaaacttaggcccaggctaagaagcagacatttattgtagctttgaaaactacaaagtaaagataaatatggcatgtatttaaaaaccctttatttgaaattcttaattaagttgaaaattgagactgtatttgtgggccaaagtgactcagtccagtcaaaggtggaatgctccactcttactaatagatgattcttcaccattacgttctttcattaatcatcaaaaggagtgtttacgagttcatcatagaataaaattcgtatttcttggcatagcgttaaagtccatccatgatctgactctgtggttcccagtaatattgcgtgctatgattcctcatacacactgtgatcatgcagaaatgttctcaaagcttgccctgttcttgctaacactttaatttgctcatattacttctcttctgctagaaggttcttcccgctccttctgttgaaatacttcaaggctcagttctataatcacagcttcttctaaagtcttcccagattttatcctttatagtaaagcaagcatcaaacaaatatcccagaacatttggctttgacgtaccaggggtaaatgaggggcacactttctactttgtgagatgcttatttggtcatgttccctctaggctgcctgtcacttgtccagctcctgaaaagcagaggacatgccctgtttgtgcatttttcccctccccataaaagcagttcatttcacatgggaagttctcaaaaaattttgatgaatgaataattattcttataaaaagagaaaatgtaattatgttggtagtgaaaaaaaaatcatgtgtagcttaggcctaggcagatcctatgacctccacttattttctctttgcaagcacagctccaagtaattcagtaactatacacagactgaagaaatgatgacatcagacctggctttgcctatacttgaatgcatttagttgttttggtgcttcacacctgaatttcagtttgcctgcatagaacacacacacacactcagacacatacatggtctacatctgtgcatgctggagggagagagaggaagaaaagcatggtctttgttttagagggttagtgctgactcaagatgcctgaaagtttcctattataccaccctgcctatgtcttatgtgataacagctatcaacattcataccaatatcagactgactcaaaagcagtctctggtttattcactcattcatatcatttactatgcatataattcatgctagactttgcttgttaatgcatttatatgatgggaaattattctaagcacatattttgcaggccatatttaagcatagaaaaggcagattaaaaggcagtgttctttgaggatctgttgcaaaattatcttaccagtacccataatatcaaaaatcctcatttgtctctgcaattataaatatatcttaacataggaaatgctactaaaatactaaaaagagcaatgagctagggaacacaaggttggtgtcccacctgatttgttagccatgtgatttgataaatattaatttctcatttttaggacaccttgtacccatttcctcttctaagaaaacataataaagcattgttctttaccttcttaatgataagaatcacgaaagaaagattgcaaagcctggtccgtggggattatgattcagggggtgtagagagaaatctagaaatctgttgtgttgtgttttgtttttattaaacgtcctggtgattgtaaagaaagtttgaaaaactctgatttagacctggcttcacacttcaaagtgtgtaagaaccaccaggaggcttgttaaaaaatgcaaattgtggggtctcacctctaatgattctgattcagcagatccgagatggggcccaggaatccgaaattttaatgagcatttccagggaattctgatgcacattcacagatcacagtttgagaaatacagatctcaactgtgacttttgggaggttagagattgtctagttcatggccataatttcagcaaccagagcagagtggttgctcacagctaatgcagaattaagtcaaattgccctatgatataatatttttcttttacttagaaaaaaagagccattatttagaagtggtaaaacaatttatctactaataaaataacaaagataatttatctatttcatctctatctcagtttctttggtactttaatgtcactagttcatttactcattcatcaagtacttatggaacacgtgaggtactggtaatacagcagtgaacaaactgacatagtttcttttctcctggaactcatggtataagtaggttttctggttatctattgctggataatgggtcactctaaaacattggtttacaaccacaacaatgatctatactcaaagtagggtcactgtgacaacttgtctctgtctcatatggcatcagcttgggcgactaactgtggctgcagattcagttccaataggctggcttacaacttggtgttgactgtctcctggaaactcagtcagggatgttagctgagcccttggtttctttccacatggccttcccagcaactgcttgggcttccgcacacgatgggagtctcagtgtagttggacttcttacatgcagactggcttttctcaaagaccattgtccaccagaatacagtataggctacaatgtttcttctgagttaccctctgaatcacagaatgttacttacattacattctagtagtcaatcaagtcattatggctcccagattcataaagtggggaattactccccactctcaatggcaagagtagcaaagaatttgtggccatctttaatttaccaaggagtgagacagatatttaacagttaactaaatacacttgcaataagaaccactaaggaaaagtatctggtactatgaaagcataaaacagagggaggtaattaggaaaagaccccctaaggaggtaatattaaagatgagatgggctctaagtcagagtgctacaataaaatgcaaggagttagtaattagaaagcaggtagaataattaggcaaaagagacaaggataaaaatgataagagctagtcttaattacttgcttcctctgtgccaggcactgtttcaagcctttacatgcattatctcatttaaccttcacaaagatcccaggtgataaataattgtattcctattttacataaactgagaaataaagagttgctcaagataatgcagctagcaggtggcagaaccagggtcttagggtcttgttttacttgagaaatgtaagatatggacgttcttgcaccaaatgctgtcatcccaagggctatgagtaggcctgaaattccaacagggaacagacacctgaagagaaggttatgcacaaagtaagagtgaacgaatgtcagaggtgaacttcatctactacaccatggctccactggagggttgtaattttctctcacagcagggtattagaaggagattggaaaatagcagctggactcctatttgtcactaggaaaggggaagcattccctttgatttaactccgtttcccaatccaatatttttttaagcccagaaagacccttattgcctctctctccaggtggagtgggggcatagatattcttcttcaaaatcagacaggatttgctaaataaataatattcctttaaataaaccttgaaagatatacgtcagctgtgtacgtttccacaggtctggtgacagtgcagtgaatgtatcacccgagtgacgtgggtcttgtgatctacagatgtaatacttcatctggacccgtgtgacatactatcaggtctgtgttgctttgatgatgtattactcgggaaaataaggttagctgtcaaaaactcattccagggaactgaaagtttggctggggggaaaattcatttcgggccttaaaaaaacacatttttcattggagtggagggaatgatgacacggctagagtcaaaaagcttgagggccttgtgaactctcatggcaattgcatctttcgatacagatgactcagggaaaaggcaagggacaaatgtatacagacagaactcttctttatttggggtatttgcagcagccaatatatacaactgtaggatggtacaaatgggcgagtttctgtaaattcccattggaatgtccttgagacagcataggctgtaaaagctatttcagaaggctacgttttcataataaacacctggaattagagttttgcatgggggctagaaagtgtcttataattattttgcatatctctatttatgggtgcattaacaactgttattttactgagagtgataatgtattctgaaatgatctttaatactgatatttcaaaatctgtttttaaaaatgtgtgtcatctgaaattaaaaaaaattgtcttcagtattttatttactttcagatgtgctgactgatcttggaactcgatttacatttatcactaaattcagattttacatccatgtattgttcatttctccctgaacttaatgtttgcaataatgcaaaacttctataatagattttcagagaaaataaataccaaaaaataaaagcaacaaacaaaaacagaacataatccttgagggagccaaatggaagaactatttcttttgggtaaaacagcaagtccatagaagttctgaagttttagagttgggctctgaatttaataacagttggatctgtatacatttattcctcactgaggtgaatttcactttgtgatttgaagaaaggccaagagttattcttaaatctgataaaacactatgacttaagtagtaaaatagtgattgtgaaaccaaaacatttatatatcttgttctttgttttttttaacataataaaggtaaagatataacacacaataatatttcattttccaaatttaaagaaaaatccaaagtgttttcaaattttgttcataacagtttgtcctaatcactgtaattacgtctgtataactcttacatatcttggtagggggtgcagtaagataaagtaaggcaaggggttggtctaaataattccctgatgacagatacaaagaacagtgatatacactcaataatcatttttaaataaattcatatattgacattgctctatgtcttaaaataacttttcagtaaataagcacataaacagtaaatgtattgccaaatgaaaattgtgattgctcctaagaacaccttaccacatctttgcccaaagaaaatacagcctcaggagagaaagactttcaaatatatcaattggtatatatatatatttttgaaaaatgtaaatacatctttactttatctaaaattattatagctcttctgttttttaaagaaagatccaagagtttataatacaataacacaaatatttattttttaaaaatcaatgtaatgaatattttaattatttagtattttttgatgagttcgaatttataatttgttttttgagaaatttgaaataatggattaaacctgatttatataataataatgatgatgatgataaaaataatattggttactcttctaaaagaaaaataaagcaaaatctatttgtgtttaaatgcccaaaacaaatccaccaaaaatagctaagataaagaaaatgaaggttatatttgcatatgtatgcccacatatgtatacatatattttacatataaacatatatacgtgtgtatatatataaagttgtgtgtgtgtgtgtgtgtatatatatatatatttcctttttatatttctttaaaacatgaaggtgtaggaaaatgtttctaaattgtgacaaacaaagaagggctaatgaagcattttgaatgaattcaagtcctcggtgtgtgaaaaaagaggggtctgggtatagactgtgttgagaacaggaaagactttgggactccctttcatctaggaaaggatttttgagtgacatgagaaagaaagacatacataagtcagagagtgggtgacattgaacttgctaagtgatattggggtggaatattcaacaaagtcaaatatcgaaaacatttaaaatttcagacctaaacctgggcccctctaccacctaagggggcagagtatttgtctcttaagctcctcagtgaagactaatatgaccaaacacgcaggaatccaggtctgacctggagagatgactactatcaccttactccacacctggaggaacgggcagagggttagacacattgctaagtgaggacaacacagaaggttatagaggcttgaaggtgaaacaatatagagcatacatcaagaaaacatcataatttgccctgtcctatgttcacctttaggaatgtggctattactttaagagagaatgtttcaaatgcacgttcctctcattacatggctcagggtttcccagattgtgccactactcccaaaagtattcagaatgactttaggtagtatttcagaaacatttctttttaaagtattcatttgttttaaaggtatgttagaaaaactacatggctggagcacaaaactcatgatttcacaagtattattgcttaaaataaggccaagtcagtatttaaatgaatttaaaaaaatgagttgatattaggcaaaagtatttagggagcacacagatgcagtgacaatagtcaagaggttaagccaaagactgagatttgaaaaccttttatgtcctgaatatagtctagatttgtcccttcttaattctgtccccattcttcctcccatgactgatataattcgtgagccaagtgtaaaatacagggtaccttgtgcaaaaatttctaaaagtttcaagacagtgacagcagagtgaaccaagtgtgggatgcttattagcacagggcacaatgcaaccgatgaaggagtctcccactcactcaggaggctggctctactctctgcatgtagggagacatgtatgtggggatgtggcaaagttagatattagtctttgctccaggaaatctgagctggagagtcagaaaatgtgtggagtatttgtgtgtgtgtggtggtggtggtggtggtaaggttgttgctattgttgttttccttggaaaaccagagagaatataagacaactctgaaactctggaagagacaaacattggaactttctctcattactcacacggaagaacatgtgaacatgtcgttctgttaattacaaaacctgagttcacatctcctttggaagatcctttttttttttttttgacagagtttctctcttgttgcctaggctggagtgcaatggtgtgatctcggctcactgcaacctccgcctcctgggttcaagtgattctcctgcctcagcctccctagtagctgggactataggctcacactaccacacccggctaatcttttgtatttttagtatacacagggtttcaccattttagccaggatggtctcgatctcctgaccttgtgatccacacgcctcggcctcccaaagtgctgggattacaggcgtgagccactgcacctggcccttggaagatctcaagactgcatgcatattgcactctcctgtggaatctcttatttcacatggatgatgcaatttcccaagttccttttctaggttaactgaggactcccagaaggccatctctgctaggaagaatggtatttcaatctctagcgcaaaaactgtgagatgatgcaggggctgctttgctttctagatgcatttcatctctggcttgataaggctgcagaaatcagaatgtttctccttttctcctaccctctctttctttttcccttaatcattttctctcttttgcttttaggtctcgtctttgagggctcgctccaggttgcccaggtttattggtcttcctttgtgttcccatactactttattctccttaatgcttcctcttggacatgaatttcagacaccaacttgaagttgttgccttgtttggctgttttccttctagatcctgaggtgtgtggaggcaagaccatagcttaatcgttgcttgttctctatattttgtctaagattctggcatggaacacacacttcataagtatttggtgaatgaatgaataaatgatttaatgtatcaattaacatacacgtgaagggtgacaacattaagatgtctgaaaaagacacaagcaaaattttctaaaacatattttttactgtttatgatttataaattatgttttccatatagatttttaggcatttataagtatctttttttgatacttttggttcaaactgtatttttcatataaatgattgcttctaaaaatactttctatagttatgtaaagtctaatttcaaaactgaattcatattgaaagcttgtatacaccaaacccataattttattgaaatattccaaaaaatgtgccttcaccataggtcttaaataacattttaaaaatgtcaatatttatcttttaaaaatagaaatcatgtttgtgattttttgttgctattgtttttaggaattaacctgctcttctaccctacgtgtaaaacaattttaatttgtgtaaccttttttttgtaataatgcggacgtatggtcattcatgtgataaatcatatctgatttctgaaatataaatcacaaagaacttcaaaaatgcagttttcttgactttctttaatttagttatggagtgtgttaggtttggtgctatatagccatgtttgatttaaaaatattcatttatgacactattaattctgtaaactctggacttagattcaagtattagttataaatcaacaaattagtaatctaatatgcctatctgcttatggatataaaagtcatacattgtatatgattacattgttaggttcatgtggaaaactcaatacatttttgacttacagaagtactttatcattaagaaattttgaaataataatatgatatgatggcctgagaaatctgtgaatcatgtgcaaataaagtagataaactaagcttttcaaaaacatgtttctgactgtgtgacatcttgtggagaggctttggaagatctgacaggggaatggccaatttggagctttcagtagaaaggtaaatgtataaaagtagctgagatttgtcacaaatgtttcctgcatttctctttggaaaacaatggacttgaattgctgtaatataaataagaataaaatatatttccagtggggatgaatagggatggatactaagtgatgtccgagtatcctttgatctgcataattcattttttcacatttttctatatcaatagtcaaatattattggagagaaaagcaacagtaaacctcagtaaatatattttctttgccattttctctccaccattgctcttgggcacatcatttttagtttgctttatctgttagtttttaatagagatatgtaagaattgcctgctgactgtggattcattgatatgtcttttacattttgtcagtttttgctttgtaaatttttatcacattgtgaagctcataatagcgtatgattgttatacatttggtggtttttctccttaattttaaattatgtcctctttcttttgcctaatttcttttccgtttgatgtaaagttgctacaccagctttaacttggtagatatttgtatagtgtattttccctcccttttatttctaaccatttagctgggatttgaatttttatcagataagacaacatgtcttggccaggtgtggtggctcacacctgtaatcccagcactttgggaggccaaaatgggaggattacttgagcccaggagttagaaaccagcctgggcaacatagtgagtccctgtctctaattcaaacaatctaaaaaaaaaaaaaaagataccatgtcttttaacgtgtgagtttaaatggttttacatgtgacaagactacttacaaatttggaatcttctaacctctcgttttgtcttttgaactgattcttcttttcctgtgtttctttcattcctatcttttactgatttcatagagtttcaatactcttttttttctttttgacggtctgtatgcaattgattagttttggtggttattattaaatacataacatacataattagtcataaattgttctaataatatttaatgttattcagtgttttcatcttcctctcaaatatgacaagaatttagcatttttttaaaacaaatgtttctcattttttgttattgccccactccaaacccaaggaagtttctctgaggcaaagtcatttctactggctgtgtgtgctttaaactttaatcttattattacacattgtgtactttatatttttttaatttttatttaagttctgggatacatgtgcacaatgtgcaggtttgttacgtaggtatacctgtgccatggtgatttgctgcaccccaacctgtcatttaggttttaagccctgcatgcattagctatttgtgctgatgggctccctcccctgcccaccacccccctacccccgctgccaacaggccctcctatgtgttgtttctctctctatgtccacgtgttctcattgttcaactcccactcatgagtgagaacatggaggtgtttggttttctgttcctgtgttagtttgctgaggatgatggcttctggcttcatccacatccctgcaaaggacatgatctcattcctttttatgactggatagtattccatggtgtatatgtgccacattttctttatccagtctatctatgatgggcatttgggttggttccatgtctttgctattgtaaatagtgctgcaataaacacacgtatgcatgtatctttagagtagaatgatttatattatttctactggcatatacccagtaatgggattgcttgatcatatggtatttctgtttctagatcgttaagaaactgccacattgtcttccacaatggttgaactaatttacattcccaccaacagtgtaaaactgttcctaattctccacagcctcaccagcatctgttgtttcttgactttttaataattaccattctgactggtgtgagatggtatctcattgtggttttgacttgcatttctctaatgatcagtgatgttgagctttttttatatgcttgtttgttacatacatgtcttgagaagtttctgttcatatcctttgcccactttttgatggggttgttttatttttttctggtaaattcttttaagttccttgtaaattctggatattagacctttgtcagatgggtagattgcaaaaatttcttctcatcctgtagcttgcctgttcactctgatgatagtttctttttctgtgcagaagctctttaatttaattatattccatttgtcaattttggcttttgttgcaattgcttttgacgtttctttaatgaaatgtttgcccatgcctatgtcctgaatggtattgcctaggttttttctagggttttttatggttttgggttttacatttaagtcttcaatctatcttgagttaatttgcatataaggtgtaaggaaagggtccagtttcagttttctgcacatggctagctggctttcccagcactatttattaaatagagaatcctttttccattgcttgtttttgtcaggtttgctgaagattggatgggtgtagatgtgtggtgttatttctgaggcctctgttctgctccattggtctatgtctgttttggtaccaataccatgctgttttagttactgtagccttgcagtatagtttgaagtcacagtgatgcctccagcattattctttctacttaggattatcttggctattcaggctgtttttttggttccatatgaaatttaaactactgttttctaattcttagaagaatgtcaatggtagtttgatgggaatagcattgaatctattaattactttcaccagtatgggcattttcccaatattgattcttctatctacgaggatggaattttttttatttgtgtcctctcttatttccttgagcagtggtttgtagttctccttgaagaggtccttcacattccttgtttgttgtattcctaggtaatttattctttttgtagcaattgtgaatgggagttcattcatgatttggctttctgtttgtcttttgttggtgtaaaggaatgcttgtgatttttgcacattgattttgtatactgagactttgctgaagttgcttatcagcttcaggagtttttgggctgagatgaatgggttttccaaatatagaatcatgtcatctgcaaaaagagacaatttgacttcttctcttcctatttgaatacgctttatttctttctcttgcctgattgtcctggctagaacttccaatgctatgttgaataggagtggtgagagatgacatccttgtttagtgacagttttcaagggaactccttccagcttttgtgcattcagtgtgatattggctgtgagtttgtcataaaaaactcttattattttgagctatgttccattaatacctagtttattaagaatttttaagatgaaggaatgttgaattttactgaaggccatttctgcatctattgagatcatcatgtggtttttgtcattggttctgtttatgtgatggattatgtttattgatttgcatatgttgaaccagccttgcatcccagggatgaagctggcttgttattggtggatcagctttttatgtgctgctgccagtattttattgaggatttttccattgatgttcatcagggatagtggcctatagtcttctttttttgttgtgtttctgctgggttttggtttcaggacgaagctgacctcataaaatgagttagggaggagttcctctttttcagttgtttggaatagttttagaatgaatggtaccagctgcactttctacccctagtagaattcagtagtgaatcagtctggcactgggctttttttgttcggtaagctattaattactgcctcaatttcagaacttgttatttgtctactcagggattcagtttcttcctggtttagacttgggaaagtgtatgtgtccagaaatgtatctatctcttctagattttctagtttgtttgcatggaggtgttcatagtattctctgatggtagtttgtatttctgtgtggtcagtggtgacatcccctttatcattttttattgtgtctatttgattcttctcttttttcttctttattcctctagctagcagactattttgttaattttaaaaaaaataccagctcctgcattcattgatttttgacatgtttttcatgtctctatctccttcagttccactctgatcttagttatttcttctcttctgctagcttttggatctgtttgctcttgcttctcttgttcttctaattgtgaaggtagggttgatttgagatctttctagctttctgatgcagacatttagtgctataaatttccctcttaacactgctttagctgtgtgtcagagattctggtacattgtctctttgttctcattggttcaaagaacttcttcatttctgtcttaatttcattatttactcaggagtcattcaggagcaggttgttcaatttccacatagttgtgtggttttgagtgagtttgttcatctcgagttctaatttgatttcactgtggtaggagagactcttggttatgatttcagttattttgcatttcctgaggagtattttacttccaattatgtggccaattttaaaacagatgccatgcagtactgagaagaatgtatattctgttgatttggggtggagagttctgtaggtatctattaagtccacttgatccagagctgagttcaaatccagaatatacttgttaattttctgtctcattaatctgtctaatattgacagtggggtgttaaagtctcccattattattatgtgggagtctaagtctctttgtagatatctgagaacttgttttatgaatctgggtgctcctgtattaggtgcgtatatatttaggatagttagcttttcttgttagttcatccctttatcattatgtaatgcccttctttgtcttttttgatcgttgttgatttaaagtctgtttctgagactcaaattgcaacccctgctttttctgttttccctttgctttgtaaattttcctccatccctttattttgagcctatgtgtgtctttgtatgtaagatgggttttctgaatacagcacactgatgggtcttgactctttatccaatttgccagatctgtgtcttaattggagcatttagcccatttacatttaaggttaatattgttatgtgtgaatttgatcctgtcattgtgatgttagctggttattttgctcgttagttgatgcagtttcttcctagcatcaatgatctttacaatttggcatgtttttgcagtggctggtaccagttgttcctttccatgtttagtgctaccttaaagatatcagatacaaatttagcagctgaaacctgtggccatcccttagtctctcaactaggcagcagtgaaaacactatgcagtaagaaaaagaactaatcttgtgtgcagaaagcaaaaaatttaaaaatacacagattattttcaatgttctctactgctagcactacaatcccttattccattcctcagatcctgagacacccaatgacttcattagagagagtccttcttgcttaacctaaactcagttgagttttcatcatttgcagccaaaagaattctaaagaacacagacattatttgtttacatataatttgttttcccttcctatcaaataatgttttctccatagatggggagcacacaccacacacacacatgcacacatacagatgcatgcacgcacacacacacacacacacacacatattatgagaagtaatttctcacactggctggaaatcttgacatttagagttcaaattactaaattgagacttttattcttttggggatgatagagagacaatagaagactcaataaggcacaagacattttttaaatattcataatgtgatgtgacttgaaatatcaataagtggagacggattttggaggaaactggcaatgatattaaagcaatgacttgtatccacttacgtctttataaaaattttcctttagaatgactcttgtgattttttctgctttgatcctgggataaaacttatttctgagatctactatccagaagaacttctggatttttaacattattccatttttctaaagtgtcacaataatcaggggaggagggtaaaaattattgaagattctggcccataatatacaatcggtcatattttggctaatgagtgcatggatgattagataatctaattaagttgatatgtactgtaaatctcatagtttgactttcacatcaagggacatttttttcttgtgtgttaatatcaatcctgtatttatatttatagaacataaaattgcagcattttaaacttataattgtttgccctggactcttagatcctcgttacttgaggtgtgctccggagatcagcaacagtcacatcatttgcaacattttgggactggttaaagtatagatctcagtctcatccctgacagctgaataagaatctgtatttgaaataaacccccaagtgttctgaagcacattaaagttaaagaggctttgcaacacatgacacattttttatgttgttttgaaattatgaaatataataaacctaaccttgataaaatgtcgtgttatgttttccacttaagctgcatagtttttttcatgccacagatattaatgactaatttgctgtgctaaatcacaggaattggtaatcaaatgagaatggctttaaacctatactttgatgaaattgacatttaaaaatatagtaaacgtttttttaaagcaataatgcagaagtatggggcatcatttagttttatgttatgggctttttttgcagaaaaagtatgatttctaaattaaatgtattttagagatctacaaagctaccagatgtattgattcttatgtttgttggtgttttcatataacattgatattattcagagcacaccagttggctagaaaattttagggtttatttcattggcaatatcatattatctcttgatactaattggtattaaattcagaaaaatcaccaactgcattagcagttgtgcatgaatatctgagtatgctgttatttcaaatctggaagtcattgtaaggacatcttttttttagaatttaagttaatattgtgctacatgactgtttgtagcattgaaggggaactaatctttatcaatcatttaattacaatgaattaaagtatatatgtaattacctacattttattaaaattggacatatttataaggaattctaggtgaaatattagtcttagcattatgtgaactggactctgattacacagaacttcccaatgcatctttgtactgcaccaaattaactctagactcctaagccctttacagcttgatgaagcaaaaattcttctgataattaaatccaaggggaattttactacattcttatttttccacaaaaataactaagaagttcttttaacacgaacaaattctttcaagaaatatttattgagtccctctatgaagaacataattcagattagcaggtgggaaaaaacaaatcacaaaacaactgtctctttcctgtatagtccataagcagaatatgtacatatacatctgtctttgggcgtgtgaccatcattgaagagaaaggctaatcatttcatcttattttaaaatatatttcaagttctctatatgatttttaaataagttgtaggccttactaagcactgatattatgctagcaaatttagtaagcattcaattttattatctcattgaatgtattaaaaatttgatgaactgtatagtatgtgttgttaatcccattttgcacatcagaaaacagaggctctgcaagcttttggctatcttgttcaagatcacagaaatagtcagttgtggatccagaaattatagccatccttcagagtgtatgtgtatcgagtttattgtaagcttctgattatgttgaataacaatgaataagcactaaataaggaaacctttacaaacagcataagaaggctcatcttgaggacactgcccttagacacagtagcacagaactaccatcaaaagggtgaaataatttacatggaatcctagtgcttgtcaacaagcacaggttttctatttttgcctccactgacagagaggatgagttttagtacagacaatgccagtctgctagtacaacctactgtcctgtgacagcacaaaaattaacttatccaaaaggatagaaaatgaaaagaaagtttgagtccgcttatcatgtgtgccagagtgtgaccacagtcgttgtttaccattcccctctctcactgtaatttttttcccactggatgcctctgagtattactttccaacttgatgatatttcttggaaaaatagcaccctggcaggccaaagttagagaagtccagttggtacctgacactcacttttttttctttttttcattccacacccaacctttcaagagagaaatgcaaggcaggcaaactggtgagtcccctgaaggcccttgaagtgactaatgtacactctattttgcaatcacatggggcctgtgaaagcacgtggggcctgtgactatttttatctaactgggttagagttggactccccatagacccaaaagtataggaatctagatcatcatttaggaggtagcttcgattgaaatgctggaggcttgaacaggagtcctcttggtaacaaagaaatgaaaggctcctatcttgagttctgcatggaagactccctcttacactttttactgttgttttcaactaatacaaggactactgatttttctttttatattaaagttacacttggcctaaagttttatatttgtgagtagtttctacaattttgcacagtttaatatgttatgtatttagtctcaattatcactctccacctcctacttgtaatacatttgtaactggtaggaactagttcatttaaaccgtattaatcacactctgtctgaattaatatttgttagcactgattatactgatggctacttcacatttatacttcacctcccctccctttttgccagctaccataaacccagctgtattttattctaaaagaaaaaagaaagaaaaaaatctgggcccagagctaagtgtcaaagataatagaaacaaagtgctgagatttttcctggtggaataatggacacttttcttacacagactctttataaagtgacatgtttatttagtttctgagcagtaatgaaatgatcaaaacagtattgcaatttataaagtataatacttggacataccaagccttttattctctcaagtcccctcgcagaaatgacaaacacaaaggctaggtcagttactattcagtagtgcatcagagctggcttgtatattactggtgtctcatcccaattccttgttaatgatgtcaccttgttgactgggaaaaaaaggcatagtaggagttatttgctctacaggagtaagtaaatgctacaaattagggctccctttctcacctctcctcctggaagggagcaataatgctcctcattgttgagcatttaccagtgcaccattgcctatgaccatatcacgcttgctgtcttgtatcatcagcactagttcttccttaacaaatgcatgccattatgcacaagtctaaccaaacatacactcagaatgactgcaaattcattggaaaacatccaacacaaagctcacacttggtattttttggcttccttgggcacaaattaggatctcaggcaatatttgctgagtgaataaattggcatatataataaaataaaagccttatctatttgcatatttaccaccatcttcagaaacagatgcatttcatgtagactaactctgtcagtaaccatagcatgctagtctataatcattgttggaaagtttcacaggataaaataaaaagttattgaaaagggagtactgaactcaaaatcaaactgaactacttgctaaatttgggatattagtagagttattcatattttatacattttattttctcatctgaaactgtagacaataatatctaccatgggtttattatgaggattcaagtaatatttagcacgtaatctgtattcaaaaattgcagtagacactgccgatacacaacaataacacttgctatttttacatttattatcttcttaaatatagtctgctgaggatcactgatgtttctaaacatcatgtgactggaataaaaaataacataagattttccagatatgaagtcactggtaattcattgaacaacactgaatataaatttcaacgattgggatctttcattgagtcacagaattcaagtaggtatggcctaagcatttactttacaaaatagtaagatgtacttttaattgtctagctgaagtttgctattaaatttacctaaataagagatttaaattaatggtttgttttttttttgagagaagtctcgctcttatcccccaggtttgagtgcaatggcttaatcttggctgactgcaacctccgcctcccaagttcaaatgattctcctgcctctgcctcccaaatagcttggattacctcgcttgccaccactcctggctaatttttgtattttttagtagagatggggtttcaccatgttggccaggctggtctcaaactcctgacctcaggtgatccgcctgcctcggactcccaaagtgctgggattacaggcatgagccactgcgcccggccattaatgataaatttttaagagcagagaaaagcaatttcctaaatatcaaagaactaaaaacaggcattttttggcctttgatgttaccctcaaggaaataggtgataatacaataattttactctaaaataatgattctcaaacattagagagcagaaaaatcaccagagaagcctgtggggaaaagtgcagattattcacattccttctactgccttcctatccagggagggagagtagagaaggaagaagggaaggagaagagagaggaaggaaagggagagaggaaagaatgagtgagaggaaaggagggagggagataaaaaaagggagggaggaagaaaaggaaataggtgactatttcccaaagagattaatgtttacatcagtctcctattttttttttgagtcttgggatttgaaaaatacattgggatttaaagtgatgtcattcagatagatttatctcttaaggtatatcggcttatttgaaatggtatcattaagttaaaatgaaattaagtcaaatatgattttccacatccacgttccaggccacataatgaaataagaatagcaccagctttaatcaaatgcaggtgatataactgtacaacagaaagccttcagaagggatgtagattggtgaagctatgccacagagtcaccaatgatacaaaattgcacttgatacagtcctgcatcccagggtgccctgtaaaattattatgctcttcataactcatatccctttattaatgtaacacggcataaaaaaggcaaaaccagtggtatcctggaagtcagaaggactacactccttgcagaaatctgtcactagcatgactttaggtaacgatggcataataagaattccctaatagttttttgacttataaatgtctttcttgatctttttgttcttactattagtttttatggaccaagttatctgcattaaaggtcaatttcttggtccttctgctaaattgtaagcaaatgtttttgctttttaagcctagtaatttatcaagaatagcagctatacaccatgtaccatgagtggatatatagctgctttgaaagtgtgcaaactgacacatatttgcttcaaagttttaaatccttgattttttatgagagtaaaattttaggcttgaatagtggtcagatttagaagcactggactgaattttgtcttaactccagaatccaaaaattattctttctataaaagactttacagtcatgtgtcacataacagtattcaggtcaatgatggaccacaggtacaacagtggtttcataagattataatggagctaaaaattcctatcacttagtgacgttgtagttgtcgtagcacaaaacattactcgcatctttgtggtgatgctggcatgaacaaacctactgtactgacagtcctataaaagtctagcacatggaattagtacatactaccagagaatgattataaacacctgtgttactggttcgtgtatttatgatactccattttttatcattattttggagtatattgcttctacttatgtaaaaaagttaaccgtaaaacaggcttagacaggcacttcaggaggtattctagaagaaagcattgccatcatagtggatgatagctccatgtatgttattgccccgggagaccttccagtggggcaaaatgtggaggtggaagacagtgatattgatgatcctgaccttctgtgggcctcagctaatgtgtgtgtttgtgtcttagcttttaataaaaaagtttagaaagaaaaaagtagaaaaatgcttatagaataaggatataaagaaatataattttttgtacagctgcacaatatatttatgttttaagctaaatgttattataagaataaaaaagttaaaaaacttataaagtaaaaatgttacagtgagcaaaggttagtttattattacagagaatttttttttatttttttgagaggaagtcttgctctgtcgcccaggctagagtgcagtggcgcgatcttggctcgctgcaacctcagcctctggagttcaaatgattctgctgtctcagcctcctgaatagctgggattacaggcgcatgttgccaggcccggctaatttttgtattttagtagagacggggtttcaccatgttgctcaggctggtctcgaactcttgagctcaggcaatccgcccatctcggcctcccaaagtgctaggattactggcatgaaccactgcgcctggccaatattttgtataaatgtaaagtagcctacgtgtacagtgtttataaagtctgaagtagtgtacagtaatgtcctaggccctcacattcacttaccactcactcactgactcacccagagcaacttccagtcctgcaagttctattgaatggtaagtgccctatacggtgtaccatttttaatcttttataccatattttagtgtacctttttacgtttagatacgttgagatacataatgtagtccctgtgttacactgacctacagtagttagctcagtaacgtgctctacaggttgacagcgtaggagcaataggctacaccatctagcttaggtgtatagtaggctacaccatctaggtttgcctaagtacactctataacgtttgtacaatgctgaaataagctaaggatccatttctcagaatgcatccccatcattaagtgacgcaaaactgtattttaaaaataatataatagtggatcccaaatctcatcagtgaatcatcttctagtgcattaaaatgtaaatatacttcatgactaccgattaacataattgatattacagaaacaaacatatcggagtcatgtgtcggtcagaattcagacaggatacagaaactattctaagcatttcaagcagataattcaatacatggatttgatgacacaagcaacataaaagcttacaaagtcaaaaagagaatgaggaagcaacacagaagttagcaacagcagactcagctcccatccctagggctggagagatagaagaaatggattgtatcagaccccagagagctgttcagttgctgcttgatgggagttgcaaccacccaggggtgcagacgttgcctgtaaacatgcccaaggcacagcaaagtgggaaagaaggaccctgacttctcccttctgcttttcaaaagtgtggggaatgcgtctgagaattaaatagtcaaagaatggcacaaatagcatgtctacatatgtgttgttccttaaagctgtcctcttgcaagatttcacattcactcaaatgttgattccattgcacaatatatttttatatcttcacttttagggtttttgctacccgcaaaagaaaatctgtctttcctagagtccatgaatagcgtaagttcatttatgtcctggctcactgttataattactgcgcatgttaacatgactgtaatttgcctgtgctataagatgtgaatcaccagatgttgactgccagaagatgagatctgtctgtgctagaaagtttcaagagctttcccatcagggaaattaaggatcatgtactttggactgtatttgcttatcacacaatttgagaaagctcaaattgtgtgataggcaaataaaaatgtataacactgttagttttaaactactaatctttaatggttcttgaatcaggactttaaggccagttaatggtggcatagggagaatgctaagatttgtcgagtacctactatgtactggactctatatagatagcttgcatgcattatcttacaattatcttacaatattacaagataggcatgatttttagtttctttctttctttctttttcttttttgtttgaccaagtctcactttatcaccaagctggagtacagtgggccaatcacagcccactggagcctcagcctcggcttcctgggctcaagccatcctcccacctcagccccccagttagcagggactacagcatgtgccaccaggcctggctatttttgtattttcagaagagacagggtttcaccatggtgcccaggctggtctggaactcctggactcaagtgacacactcacctcctctttccaaaatgctaggattacaagcatgagccactgtgcccagccaggtattatttttaatggtctctaatatccatgctctcttccatatatatatatataattatatataatatattatatataatatattatatataaattatatattatatataatatatattatatattatatatataatatatattatatattatatatattatatataatatatattatatattatatatattatatattatatatatttaatataatatattatatattatatattatatataatatattatatatattttatatatattatatattatatattatatatatttataatatattatatataatatattatatatattttatatattatatatatataatatatataatatatattatatatatataatatatattatatatattttatatatataatatatatattatatatattatatatatatataatgaatattttggaccaaactgatttgtggctttattttatgtgaccttacattatattggtcttagtttttctacttatcttcagtttaatttttttgtatatttttgtgagcaacttttaaactttgggggaattaaacatgctctaagtaaagaaatgtcactccatttgaaatataagtgtgaattaccgtactggattgtgaactttttttacgacagatactattgtattaccttatattcttccaataccaagtgccagatagaaagtgactttaagatttttgtgtgtgtgtttatgtgtgtgtgcccacacatgaatgtgcatattcattatttcatttaagtttgatttttatgttatgaggacatttatatgatggtatctaatatatcttccgcttctctgtcattcttgtatgtatacaaacttattaaaaaagaaagtatgtattttccacgcttttttctgggtcctctcctaagaattaggtttcactaacttgagtattgtattttctcactgtaatatactgaatttgaaaaagactctctaatctctaaagaaaaatttgcagttaaaaaattatgtttgcactttgttgttttgctgtaacttttctatatttctattgcgtccttcagtctgtaagacaataaacacaagtcgtaggatagagcagtcttctgagtaccactgggatgtttcaatctacagaagtctgacaattctcatcacatttttttaataaagtgggctctttaattttagagtaatctttctttgtcttagaacaataagtttgtgagagcgtcagcatggtctctcaacaattcttgtcagtggaaaatgtgtttacatgttgctagcaacactatgaattgctcactggggacctaagcaggtgacaatgaggtttattgcctgagagtgttagtgattattttacataacttggcttgggaacatactacaaaacaaacaacttttgagagcttttttgctttggtaattttgtgttgttgagatcatatggagaggcaggcagctctgcagactatggaacaatgagctagcatatataaatccgagctgataccttgaggtaattcttctttgcaaagtaaaaagatattcggtaatcagacactgctaatgtgtctccatgataatatattcttgtcttgaacacagcaatttatttttctgctaacatattcctgctagcatttatgtctctatctaccgctcaattacatatgcatgagttcatgttttcacattgtgtgttttattcacaccgtcctgtgcacttgaaacacttaatccaacagtgtattatttatctctgtggagcagtgtgttcatacaggtacaagcttagcgaagaactttctaaacaccacagaattacaggtcaacaaacccagtgattttgtatgcatttgacaaataaccatttcattcaaggagagaaaatgtcaataaagcagcttttaaaaaattaattgagtgtatgattgaccggtggattgagattggtcagaataccactcaaagtagaagagatttggggagagaaatatactaaaatattctgctaaactagaaaactgcttttcaaacaattggcaggtgaaggtcttcttcccaggtcctaagagaaacggaagaatctggtatatctaagtgattgtggttttattcttgaacttagcaaacctctgcctacttataaatttatacatgggtgtccatcagagtggcatctagatgggatgaaggaaaggatttctggtactctctcctgcttgatttctccattggtcttgtcactggaaggcaatgtgggacactgcagccagaaaatgagacatcttagttgctgctatgacgcatgccactcacttgcttttccttgaaccaggaaaacctcacagctatttactaacttttcctttactttgacagacactgcaatggaaattcatattgatttttaccagttctaagatcttacatcttttaagcctcataaaagcaaagtattgagaagaaaacccccaatacattatcaccaaaattggacagaggaggaagataatttatctatgtaattcagtaatattctctttttctttagtgggggattaaattttttgtaaccttcttaaacttttgttacctttgtaatttaaagtgacaagttaaatgctaacgcaattgataggggtgagcaactggtcaatgactggcctgatcagactacgtaatgttgctgaaattgctaaaatatgcaggtccattgtaattttgacagaaaacagttttctgcagggctttatatctccctggtgatattaaaagccaacaatgttgtaagtaccaaatttctttggaggaaagttgagagacctcagcaacctagacgtcatgttaaaaataaataaagtctgagtatcttgagatttcatctgtgtcagttttgaatgggaaatttgatggtagagtataatactgcagttaaaagacttgcattcactttcctcccacagccaagttacaaattataacaagtaaggacctatttatttttttgcttaggcctaggacccctaaggcaaaataaattggatattttgtgcagtaatttagtgatgtggtggtaggcaatcggagtggtggaaaagggtatgcatatttagcatacaccatttaaggacacgagttaacatttattttagtaactttggtggagcccaggacatctgttaacggctagtctgaacaataaacatctgccagtatcttctttctaaaaatagtttctttcttttgaccatatcctttttatttctactaggtgctctttatttttgttcctacatacagaaccagattattgttagttcacacggcatggttttacaaaagagaaaaaggtatgacatctgagtacattcagcaccacacaccagggctcatggcaggtccagctgtgtaatttacagagcccagtgcaaattggaaatatgggatcctttattaaaaaattattaagaattttaagatggtgagactggatttctgaacctgcccagtatgttagagcactcctagatgtaggttagtcagtaatgaaggtacactggataacatctcttgctcatctagctaaacacccagtcaacatgaagaaggtttcatccatttgtgatcaaatccattttattacttaatctttgaggtggaaggtggtgtaatttagtagtttatccttgaggaagtcagatctgagtgaattcaggctacatcacttcttgtttggctggtctgcaaaatggtttggtttaagtaccttgtctgcaaaatgagaatatctgcaacatagaattctggttaggataactcagatacatctctgtcataggcattcagtaaataatatctctgactatggtcaaataaaatcaagttattctcttaatgaccaagaattatattaattactactagctttggttatcaaaaacagtgccttgcaaatctaaaatataatttctagaaaataagaccctttataaagagagaaagcattgtgaaatcaaacagttagatgatttcaaacataaatgtgacatgaagattttctttaataatacagtaatagaagcttaaattaggtttttaatcgtgtgaatgtgtgttttatggaagaagaattgtcttgctataattgtgctttcatttaaggagaccaattatttaaataaacatcaccaaggaaattaagagatttactatgaatgagccatacaaaggtaaataactactattctatggagagaaagaaaagaatttaatctggaaaaccttgagtgttagccagttaaaatatttgcattgcccaaaatgatttccatagcaatgggaatttggtggtctcacaacaatttaattctaacattctatctcatttcctaatatatttcatcttgatgagaggccaaaaattcttgtgatatcaaaagatataaatatcaatggataattttttccagaaaaacacattttaagtatagagaatggtacattagatatagcatggaatttggatccaaacagactgttcaaatttcatcttctaacattgaataatatttttttaatttggcaagccatttaacctctctgatcctagattcttcattcttaaaatctgggcaacaatgcccacataacaagaattgaattaagaatgccgtcttatgtatgtaagtggctttccaacatagttgttgctcaataaatgatggcttttgctacttattaacagtaataacaaaattgagaatatttctgatttttatatttgcattttatcttcccaaatagattattcgctcgttctggactggcatcatagttaaactccttttctttcctcaaaaactctcagcacaactttaaacagctaacagccaccaggaaaaagaactctgtaaaaaggcattattttattcaacaatgaagcattctgtatctagacctgggctgaaaatccagatgcttacagaccaagagagaaggtggcctggatcattccttatgaaattttgacttgtgctcctttgatccagacacacatcatgtcacgtaaatctcctacaaatattctccattctaccaagatatgccctttcctgtttttagaaagttagagattttcagtctatctttcactttaccacagttcggtagagtcataggttcaatactattttattttcctcttaatgctaagaacatccaagtatataagtgtaatgacagatagtacctggcagtctaacccaatatcaggggacattgtgaagtggtggagactgtggtcaatgggcaagtttacgccctaccccaaggggcagctacacatctgatgatcttggtaataaattctgataatatttataaactattttcttcattagcccaggtgctggatttctataactattaccgactagttaaaaggagtaaaaatggtagtgacttaatgcatttttaagatctttccagatttcgaggagcaaggaagtattcttgtttactgtctgccgaatggaggtgtcttgaaagaatatgtgacaagataaacaagagaggaatgcacttcagcagccatggagcaaagtttcatagagaaatgcaatgctgtttttgttcagtaagaaaggtgtctgccagcacctgcagtgactcatcacctccttaaggatttgtcctctgaagtagccattcagttctccctgttataacctgttgctaacccaggtactctttctgctcaactctccatgtgtttggataccactactacatgtttttgtgctctgtttcctatctcgtgattgctactacatcaataatgcatgacttttagctgtctcgtagtttttccagcttgcacctcagttcagattcctctagagggaagatcttactgggtctgttagtcaccgtccagtttacctggtgttcttcttggccaagctttcaagtcactctactgcttagcttgaagaccactgatctgtggacacgtccctgaggtcaggtccccacattggtccaatcagttgtggtcaaggttggtagagtcaagtggtctgaagctcagtgactccttcacaagaaactccttgaggtcatgacaaactccgaggcacctcagaaggaatagaaaatattctaacttgtattatgttgactgactggtacaaataataatttttaccctatctcttcaacttaactataggttgccaaaaatcctcaatgattcaaatgcatttttaattcaaaaaaacaacacattatttgatatttggctcagtagtcctatgtcttctgaagttagcagggtttacaatgtctgttctgcccagaaatgatttatgtcttttgatactcaaactctattaacagttggtaaagttttaaaatagaattgtaaattttcatattgctctacacagagatcatatgcatgaaagctcactgatgatgtaaagtagggctgcttgtgcagtctaattctgaacagtgggtcagtaaaatatcaaattaattattgggagagatttatataaagtgtcattcctaataggtaactaaagtgtctgtcctgaatgtttgatttctaattagctatgaagttctagcactagtgagttatgcacagattcagttaggaggagctcctttgacatagaggacagaacttcagaatgaataatgccttacaattactcatttcttccttttagatttatatctaaaatttcctattcccatcaaagtgaagtatagttcagttttctggacaaatattatctttgaattctgaatcttcacaactgtgaaggctttttatttcttgtttaagtccaaagttagaattctctgttggtaatgagttactctgtctctttcagaagtccgttcagtcacttctccacacatttagaccacatgcacacaagcatcatgagagggagaaaattgaaatgttctaattacaaatgaataaatattcactgaaataatttgttttctattcaagttttaccttagtaagattccaaattgaaactcttatctatgacgtttgaacaactcagtgaaaagctacagttaacaaaaagtgaacaagagaaccatcaataggaaatccctatgcgatatgttaacataaactaatattaacaaaaagactgttggtttttcagatccctttcttctgctttactttgatttttagtcaattgcaatatggaccataataaaaatgacctaattatttattatcattattattattattattattattattttgagatgaagtcccactctgttgcccaggctgaagtgcagtggtgcaatcttggctcactgcaacctccacctcccaggttcaagcaattctcctgcctcagcctctggagtagctgggattacaggcatgcgccatgtccagctaattattgtatttttagaagagttgggatttcaccatgttggccaggctggcctcgaacccctgacctcaggtgatctgcccacctcggcccccccagtgctaggattacagtcatgagccactgctcccggccccccaaaatgacctaatttttaaaaacctaaccactaaaacactcaattttgattattcctttatttatcggggtaaaaaatacataatatgaaatctgccctcttaactaatttttaaatgtacactatggtattgttaactataaacacaatgttgaatagcacatctctagaacttttggagcttgtataattgaaactttatgcccattgaacagcagctcctcgtttcccctcccttcatacttggcaaccaccattccacctctgctttcatgaccttgactacttcagatatgtcgtgtaaatggaattcatgcagtatttgtccttctgtgactgacttatttcacttagcatagtgccctcaatgttcatccatgctgtagcatttgacagaattttcttctctttttatgactgaataatattcaattgtatgtgtatgccacattttctttattcattcatccatcaatggacattaagattgcttcaagattatgttgtctaatttccacgtttgtgaattttcaagctttcttttcgctgtcgatttctagtttcattccactgtgatcagaaaagatgcttggtatgatttcaatcttttaaaatttattaggacttgttttttgtgatctttcttggaaaatgtttcatgtgctttaaagagtaatatacattctactgctttgggtagactgttctgtgtattagtcataaacatttttttcctaaggcgtagttcatgtcttctgtatcctattaatcttctgtctggatgtcttattcattatatgatagggtattaaagtctcctactatgattgtgttgctgtgtacttcttttagttgtcaatgtttacttcatatatttaggtactctaatgttggatgtatgtattctaataattcctatatcttcctggtaaattcatacttttgtcactatataatatccttctttgtttgttgtaacagttttttacttaaattctattttgtttgacataagtatgtctgcctagctctcttttggttaccagttacatggaagattcttttctaccctttcactttcagtttatgtgtatccttaagtgtaaagtgagtatagattcacataattggatcctggttttttttttttttttcatttattcagccactctgtcctttgtttggggatttaatctatttccatttagagtaattattaatagcaaataaattaatattgccattaaaaagtattttctggcggctttatagatcttttgtccttcttttcctctattgctgtctgtgttttaaaaatttttttgcattgatatattttgatacatttctcattctcttttgtgtttctgctatagattttctttgtggttatcatgtggcttatataaaatcttatatagttatagcaatctcttttaagctgatgacaacataagttcaattgcatacataaactacttttaattctccctgcaacactttatattattgttagaaattacattttcattatatatttatttctgtattataatatcccatcggttattttcaatatacatcaatgtgaaacataaattacttatttatttatttatttatttacttacttatttatttttattttatttttttggaaacagagtctcactctgtctggagtgtagtggtacaatcttggctcactgcgtctctgtctcccgggttcaagtggttatcctgcctcagcctcctgagtatttgggattataggcatgtgccaccacgcccaattaatttttgtgtttttagtagagacaggttttcaccatcttggctaggcttgtctcaaactcgcgacctcaggtgatctgcccgcctcggcctcccaaagtgctgggattacaggggtgaaccaccacacccagctggccttgattacttccatttttttttttaaatctttgtacatacgtacttgagtatttatattatgatttgtctgcatggtaaagtcaagctgaattaataatgagtatgtgaaataatgtgttaaatactataaaattgctttctagaaatttactccaatttgcacactcacaattccttcaatccaaattgtcatgcccatacacatttaaaaaaaaaagaagcctcactcttgttggccccagcatgtgacagatttttaaagaaagattttggtcgtattttagctctttgcacagtaacagctacccattctaatcccttagccacgtggcaggcttgtgggcaggtgtttcaggagttgctggcaagcagcttgcaaaagccagggtagagtaagaaagagagaaagaaagaaagaaggaaaacaacaacaacaacaacaacaacaacctttaaaccctgtctgtcctctaaatattgggaatctgtgctctgattgctggttgctgcttctgatcataggcaggaaatcattctttttgcatctcccccccatgttgcaagcttcccccatttggttgaagtgacttccaaagtatttaaagggctggggcctgttttaacctttatttctttttttttttttttttttttttttttgagacggagtctggctctgtcgcccaggctggagtgcggtggcgcgatctcggctcattgcaagctccgcctcccgggttcacgccattctcctgcctcagcctcccaagtagctgggactacaggcgcccgccaccacgcccggctaattttttgtaatttttagtagagacggggtttcaccgtttttttagccgggatggtctcgatctcctgacctcgtgatccgcccacctcggcctcccaaagtgctgggattacaggcgtgagccaccgcgcccggcctaacctttatttctaactcttccccttttgggagccagacattaagaactacgacattcaaatgcaaccacatataaaggggaaattagaaattcactgtatatgcccagagaagggtgtcaggtaagagaagacctggaaagaccttaggtttgcacctcagtctgatccctggcacagaggcagcctacaacaatcagaagaacaaaaacagaaataaaacctaatatactccatggaaaagggaggatctgattcctagaattaacacattattagattcaaatgtccagttttcaacaaaaaaaatttacaagacaaaaagaaataggaaatacggctcagttgaaagggaagagcaacaacaacaaaaactgtcagtgaatctactagaaaaaggctttaaaataactctcttaaagatgatcaaagaactaaaggaagatgtaaaaaaagtataaaagagaaatgatgtgtgaatgaaatgggaacatcaataaagaggtagaagacagaaaagaaactaaatgaaattatgagctgaaaaatataatatatgacataaaaatttacttgaggggttcaaatgcaggtttgggccagcagaaagaacttgtacacttaaaatacatcaatggacattatcaagtctgaggaacagaatggaaaaaggttaaagtgcaacccagcctaagggacctgtgggacaccataaaatacaccaacatacatgctgaaggactcccaaaggagaagtgagagaaaagggcagagaaaatatttgaaaaaaaaaaaaaaaaaagcaaattgcaggtcaatatcctctatgaacattgatgcagaaatcctcaggacaatattagcaaatcaaatttaattgcatgttaaaatgatcatacaccatgaccgagtgggatttctacctgggatgcaaagatgatttaacatatgaaaatcaatcaatgtaatataccacattaacagactgaaggaataagttcacataatcatctttattaatgcagagaaaagcatttaacaaaatttaacaaactaagactgcctctacataataaaaattatgtattaaaaaactgaaaaccaactttattctcgttagtgaaagactgaaagctttttctataacattaagaacaaaacaaggatgcctactctcactacttctattcaacaaagtactggaagtcttagcagagcaaatagtcaatgaaaagaaacaaaagggatccaaatataaaatgaataagtgaaatcacctgtttgtagataacatgatcttatatgtagaaaaccctaaagattccatgaaaaacattataaataataaattcagtaaagttgcagaatacaaaattgacatacaaaaatcagttgtgtttctatacactaataatgtataatccaaaaggaaatttaaaaaaaaatctcatctataatactatcaaaaaaataaagtacttagggaaacacttaaacaagaaagtgacagacatatacactgaaaattacaaaacattgttgaaagaaatttaagaaaacataaataaatgcaaaaatatccaatgttcatggattggaagacaatattgttaatacatctatactatccaaagtgatctatctacatattaaatggaatttctatcaaaatcctagtggtatattttccagaagtagaaaaacccatgctaaaatttatatgaaatgtccaagaaccctgaataaccaagacaatcttgatacaaaagaacaaagctggaggattcatacttcgtgatttcaaaacttactacaaagctacagtagtaaaaacagtgtggctctgtcaaaaagacaaacatatggaatggatacaaatggaatgcaatagacagcccagaaatcaaccctcaaatatatggtcgcatgatagtcaacaaaagtgtgaggatcattcagtgtggaaatggacaatttttcaacaaatgttattgggagaactggacatcctcatgtagatgactaagttggatctttaacactgtataaaaattgattggaacaattcaaaattgttccatgacccaaatataacacttaaaaatataaaatttttagacaaagatattgggcaaaatcttcatgacactgaatttgtcaatgatttcttggctatgataccaaaggcataggcaacaacaacaaaaatagacaaattagactttattaaattttctaaaaattgtgcaccaaaacacactatcaacagagcaaaacacaacccagaaaatgggagaaaatatttgcaaattttatatctgacaaaggattaacatttagtatatatagaacactcctaaagttcaacaacaaaaaaacctgacaacttgattcaaaattgggcaaaagatttgaaaagatctttatcgaaaaaagataatcaaatagtcagtgagtgatatggttgtctgtgtccctacccaaatctcatcttgaattgtagctcccataattcccatgtgttgtgggagggacctggtgggatgtaattaaatcatgggggctgggctttcccatgctgttctgctgatagtgaataagtctcatgggatctgatggttttataaagggcagttctcctgcacatgctcttttgactgctgccatgtaagacgtgcctttgtgtctcctttgccttctaccatgattgtgaggccttcccagccatgtggaactgtgagtccattaaacctctttcctttataaattacccagtttcaggtatgtctttattagcagtgtgagaacagactaacacaatgagcatgatgattaattaggaaaatgcacatcagaactacagtgagataccacgtcatacccattaggatggctagtattagaacaaagaagaaaaagaaaagaaaaggtgttggcaagtatgtggagaaattggaacccttgtgcattgtcggtaggaatgcaaaaatggtgcagccactgtggaaaacagtatggcaattcctcaaaaactgaaaagtagaactaccatatgattcagcaattccacttcttggtatacagccaacataactgaactcaagttctcaaaaagatatgtgtacacccatgttcacagcagcattattcacaatagctaaaatgtggaagcaactgatgaatggataaataaaatgtgttgtatacttacataggaatattgtgcaggaaggacacttggacacatgctataccatgaatgaactttgaagacatattgctacattgaataataaagtcacaaaaagacaaatactgtttgactccacttaaatgaggcacttaaaagttgtcaaactcacagagacatcatggttgcctgggtctgtcaaggagggggaaacacagagtgtttaatgggtatggattttcagtttgcaagacagaaagaattttgtagatgaatggtgatagttccacaacaatatagctatacataataccaccaaattgtacacttaaaaatgactaagacagtaaattttatgttacatgtattataccacattaaaacatttttaaaaatattgtcactttttagaatttgcacttcaattttgatgtttacaatcttctcatgtatttattggctatttgtagtttttaattgcctgttcatatcatttgcctattttttaaaaaaacaactgagtagtttgttattgatttgaatgaagtatctataaacattagcaaatagtcctttgtctgacatataaacctttaaagcagaaaatttcatcattatctggtgactcaggataaggtggagctggtctgagggaggaactgctattggtagactgtttttttagtaacaatttgtctcactcattttggtcatgcaaacctataatttgcatttcattgagaccatgctgtgatttcaaaatgaccttccaaaatcaaacattctatatttttggacactgaagtcccagtaaagcttgtaaaattttattttttcataaattacattcgtaatgttgtgtttgccttgtattctgggaggcttttcattcctcaaaggtgttacaaaaataaatgagttgattcataaaaatgcaattcatattttattatttttgttcccataatgcttacttcatcttgattcgtgagtgagtgatgtattggattaattcttggcatataccagtttgattttaatttgttgaacagcattattcagaaatagtaaaataaataatttcatgttagaaggcctgattctaaaacgactctaattttcagcatggcttggtgtttatcatgtaggatacttgattccacaaaacactcacatatattttgaaaactttataacatttctattcttatgcctggaaataatataatagagaacttaaagtattttagaaaccactaatctatctccaccaaacacatttaaattaacacatttaaaccctcacaatttaaattaaaatttagctgctattaattacaatacaaaaaactagttgtgatggtttagcataaaactaatgtttcaaactgcaaataatttaaacatttcaaaatggaccaaaagctgttgtttcacctttggattaacagccaattactatttaatatttagtagtaacaaatggttactttgaagagtttctatctttccacttcaaaggaagcctgtgggagcccacatgattcctgatatgaaagttgaaaatgaatcatgtatataacactcaatattgaatatataattgtgtccggaattggtgggttcttgaacccttgtggtgttacagttcttaaaggtggcgtgtctggaattgttcgttcccccccggtaggttcatggcctcactggcttcaggagtgaagctgcacacctggaaagtcgaaattagacaacataatcttgaagcaatcttaatgtccattgatggatgaatgaataaagaaaatgtggcatacacatacaattgaatattattcagtcataaagttcataaaggtggcacgtctggagttgttccttcctcccatctggagttattctttcctgccagtgggttggtagtctcgctggcttcaggagtcaagctgtagaccttcgccgtgactgttacatctcttaaaggaggggcagatccaaagagtgagcagcagcaagatttattgcaaagagcagaagaacaaagtttccacagcctggaaggtgacctgagccggctgcctggctggctcgggtggcctgcttttattgccttttctggccccacccacatcctactgattggtccattttgccaagagctgattggtccattttacagagagctgactggtccgttttgacagagtgctgattggtccgtttacaaacctttagttagacacagagtgctgattggtgcatttacaaacctttagctagacacagagtgctgattcgcgcttttacaaacctttagctagacagaaaagttctctaagtcccgccggacccagaagcccagccggcttcgcttctcaatggcagtcgcagcgggactttgtggcacctagcccgggcactctggcagcccacagggagctcatcccccgatcaagcccagcaggcgcctgccggctgcggggcccgccaagcccgcgctcacccggaacccacgccggcccgctagcgccgggcgcgcagcctcggcgggcgggcgcctcgccttccacacctccccgccagcagagggagctggctccggcctcggccagccccagagaggggccccctcagcgcagcggcgggctgaagggctgctggagcgcggccagagcggacgccgaggccgaggaggcgccgagagcgagtgagagctgctagccagttgtcacctctcacagagaggtaagtgtataatatgaagagtccggagacccagaggttcttctcagtttttcctctggctcagtgtgagaacggggttaacgttctttgcttttttggcctcccttctcatcctcaagaaagagggtttggaatcacctatagatttactgcaaaacttacgtagtttatacttcatggatcctcacttgcacaggtcactttcaaagccctgggagcgcaaatgtttctgacttcgtattttaaaattatttttcttaagccacctcacgcccgcaaccccagtggtatgcactgctggattcatcactgattagaatacattatttaaggtttcctccagttcgacaatccagtccttctatgtgaatacttaataattgtttatatctagtcactcataactgttgtcacccatagtgttttctctcctaggaagtttctgctttttaaaataacactttacagctattatgaagattgattttcactgagatgttgtaaaaactctgcagatccattatactagacctatatataccgtgtattatactagtcaggattctcctgagaaacagcaccactaggttctgttcaagcgcaggagataagaaaaaatatcccagctcaagcagtgagatgaaaagaaggggttagtcctccttcctccaccttttgttttattcaagcctgcagtggattggatgatgctcacaccatgggtaaaaggaatctactttactcattccgccgattcgaaagctagtctcatctggaaacaccctcattgacgcagtcagaagcaatgtttaatctgggtaccccctggcccactcaagttgacacataaaattaaccatcatatctgtcttcttatctttaattcttccctctgctgacttttcttgcctctgagtttaacagttctcagactgtgatctcagcattaggtacatcagaatcattaggagttttattttatttttttaatgaaattctcaggactgcaatccagatttactgaataataaaaggggggagggttgcagatacaagaaacctacgttttgaacacgtcctccaaatgtttgtgtcccctagtctttaaaagtcaactattcatttccatgttctagaaggtgtgtgtgaatgtgctttttcaaaatcaggagcagatggcaaggagaataagaatgtaaaaaaagctaaatgtaggtgaaaatttgtgacctattccccaaacaaatattaaaggatgatattattatattttgatgtattatatcacatgatattctgtgaatcaatgtacatcctctttttattatgacattttcactttccatttttcttggttctcatagctggtctaaaaagaggagagagaaaagctagaaagaaaatctgcccttgccttgttgaatttctcgcttgtagttccagaacatgagaagaggtgttctggatagactaagagaagttatggggcagagacacttggtcttacccctctattgatgctctggggagaatctttgtgtagacctcccttatactgcaaggggctgccccagtaaagttaggagagaggtgcagcatacacacacacagagtaaaggtctagtttgcacactgatcctttctgaattccctatgtgctagacgctgagttgagagcctgctgcctgccatgaggccttatgagggaactcaagatgaccacaggaaggaagccatgtgcaaagcatagaccaggaaccataatgagtgaacaggagaagcttaagggctccaatatattttcatgttgaaaggagagattttagaatgttgtggtagttagatgagtcccacttcacctcaccccaccatctcctggaagcccctgagaaacagtcacagaccacagttgggaaacacaatttccattatgagaagccatcaacactaaaagttgaaaaaacaaagggagtatttacagagggcttttcacagtgctgtaacatcttctgctagttttttaatatgatagtttgcttgaataagtgtgtctggaagatagagaatcaaaaaggaaaaacaaagatgtgaaacaattagttgaaaaagacttcaatcagctgagattccatgctggattttggaagacgtaatcacatattgtatgtgattaccaggggtaccagcaagtgtgtgtgtgtgacaaagaaaagtgtacattatttcagctgatgtgtctgttgctcagttgaaatgttatgctgcccaagctgttgaggttgtgtattttcttattcagtagtcatgcatttcactgtggatttaaaaatggagactcacctcaaggattcactggaaataaaagttattacagccaagcaagttgttcgtttgctccttattttcaagtaccaggaagtttgatatggttgaaggaagtgtataaatgaagattggtacagtataaataaataatttttgtttgatgtgaagagaacttttaacataacttttgtgaaaaaaatttttaaagaaaaacaagaaggcaaatccagccaagtgtttcttgaaagccatttctcaatgtcataaaggattcgtgggaaaatattaaatgtgggcaatcaaattaatttccattaattaattattctgagttttcatgcttcttggaatcttcctcttaagagctcagtcaacaattttagtctttacaaccacatgtaaggtcaagatggatatattaatttgaggctcagtattgaccatcatatctaggggacagctctttataagcataactttaaccaattttatattttcaactcacggttagtggtgttcttgaatataatgagtaggcaacaaaaagaaataggaagagtatttggaagtcaggccattcatttatacaaacgatttacaaacatgctgttgaaacatacagctcttacttgcagtgtggttttctgtgcatcagtgttatttacccacattttgttaacaagtgttttgtgtcatgaggttgcagataaatgcatataaaatgacaagtactattattattgattctcttaaacagtagctttgagatttgaagacattccatcagcatgttgatcagaaggaaaaaggcgccttaggaaagagactaaactggtctataaagttatttgaaggaatcatcttgggaagttagttccaaaagaaaaactttctattgccggagggctattcattatctctgaggttggcagattagtgagttgctgttgtctttgataacatgtctaaaataagctcaaagttatgagatcagttctggtattaaagagttagttttacgttgtggtattgttgagctctaccagaactccaggggctatttgagaattctgggtgtacattaaaaatccattttcactacccaggatatacttttgtctacatgtcaatggttttaatgactaaagctgggtatgcagcaaaaaatggtattggttttacagtaaattcttactcattttatttcatttttagcaacaatttaattcttaaaattcctggggaagtaaagattaatcagattggatgaataattttcaaattatgctgtgctcttaccaatttccccagaattcaatgtctgccaaacttttaatatttatttctcccagggattgtaattacattgttgcttattctagccaacatttttaaaatcggattttgtttttcaaatgtatcaatattatcactaaatatttatttggcatacacatttctaccttaccttttcaaagatcagtctcatctctagatgctattgttcttaatgatgcaaatgatttgctgtttgaccaatatggctgcataaatcacagtgagagtaagtacttgtagtgattgaaacttctaagttacctctgttctgctacaatttgctcatttcctgtatataaaaaaacacaatattttacttagtactgacttttccccatgcctgaggaagtagtaaactctccaagaaaggagaaatggctacatatttctatagaaacaggaaaacaagctataataaagactataaatttggatacgtgttaaatggctgaggagtatatctggtgctgtgatagctgttaaatgcattttaacatccataataattgacaatagtagcaaaacaatcatcatgaatagtgaaacaaacataaactaaaaagaaactgctgttcattattttttgtgactgtttctagtgccagataattcttccctactgtgataatggtatgaaacatcaatataaactataaaatatgaaggaattttcaaaatattttcataattatttcattacccacactttcattttcaaaaatatgtcaaaatatgttaatactatagtcgacttgataagctggaccttctaagaaaaagattgcactttgttttatacaataactctttcagtaacgtttattgtggacttgttgtgtgcaagattctttaccaaattacaaagataaaaagattaatgaaatatgtatcttatttcaagatactgtgaacttccttcttttccttccttcctccctccctccctccctccctccctccgtgccttccttccctctcttctttgttccctctctccctcttccttccctccattctgtaactatattttgaactgttgcttgttagacctaatgcttagcactggacataaagcatgatatttattttcattaaatcaattcaagaaaaactttcaaacaaaacagtctataactaagcagcttagctcaaactgcatttaccatttttttctttcttcctttctctccagtctcaagatgtagctttgagccaaactacaaatgtgttttctttcatcttgaaatatagcctcggaatgtgctgtgaacctccactctcctctccctttcccactttatgctcccatgccttatgcacatttatttgcctaggtacttgttaagcacacaccatgctctcttatctggtcataaatttccttagaagctttaggggccggatcctgatacagagcagacacctccagagttctttccaacgcgtgattacctcaagcctggaatccactcttgactagagattgactggaagattgactgcaattgatttgtaacctggttgggcccatcctggcacgggttccttcactagatggaataataattcaaaacaagtcatcggagcaggttgcaccgcctgacacctcctaagccgtttgtttctcctgcattccaaacctctcgctttaaaaacccctgcattccctccacaaattaaagagtggaaatgtttggaaagaattccgcccagtcttgcccttgctaccacagataataaagcttgctctctttctatcacacctcgctcttgttattttggcgtctttctccaagcagcaagcagctggacccttttgcctgttacaagtctttaaatagggtagttttcaaatgtcttcctcagtaaaaaatatgattctatccctccaataacataacctttttttttccttttctgtctgttgggaggagtttaaaaagaaagcgtgggcattccatatgtatatgaaatttcctgttggttcctgaaaaaatgataaatttttcaatgatgtatctagaaaatagtgacttctgtgatttaatttatgatatactagcatatgttttgtggcagaagaaaacccttaaatttagtatgcagacctcactgttgggggcacaatggaacagactcatactgagacttgcctgcattctggatagggcaattgagtccgtagagctgcacttcatcatctgctaagtcagcagttaattttctttctagtgcattatttacttcaaaattaacattcatgagaactcaaggaatacaagctagcctaaagagttaggctttgtctacatttgtcgtctgcatgaagggagcaattttacagcaccccaggtgccctaacacgttgacagcctggcagtattttacacttaaaattcttcagctgaatactggacattttgaacaaggacgttacattattcttggtacttacggctacacagcaaaagtaacatctgggaaggaaataagtcgttacaaatggatgtggacatctgttttctgatggaaaaagagcttctgtcctacaaaatattttcttgtaataatggataataatgtttttatttatttttatttgtttgcttttaactggagaccacagaattttcttataaaatatttatttgcaatattccaagcattgtagaccgctttgtctagtggcaagtcctgatctctgtagtaacagtgacacctatttagtgtggcagagtggctttggtgtcaaaaagacattgctgcaaatctcagtatttataacaggaactactttcaattctctcttggggatttttgttatccacatatctcccttttagtgggagagcaaagccagtcttgctgtttttgaactcttacttaaaatctaacctgggactaataaaaagaaagttagagatcctctctggcagccaaagtccctgaagtgaaaaagcagagaatgagaattgtttgttaaaagtgaccacagcaaaagctagaaggtgaggaccaaaggagagagctggtaagagatactctgtgacactggttgtccaatcattgaaaacactgagtctttgtgggtctccggcaaacttccagtcctctcctgctttcagcggagagtctccacttaataatttaagaactccacttacactagcctttctatttgcatatctttcttgatacttcttctccaccaccctcaaaccccaagcactaagattttctcagttgtccttctgaatatctattgcatgcatttgacttctattcatcgctgatctccatggccatttcccactgtctaaaacttttcaaccagtgccattgactgaggccttcagcaatttctgtaatatattcctgagtagtgcttcatgatctcatctttgtctacctttccagcttaatctgtattgttctcctttcttctatattgcacagaagccatctgggacttgcaacttccgtttgctgttcacaaaagccatgttcatttcaaggcaggaatatcctccctcacatttctcatctgctgtattcctactcactcttcagttctaactgaaagttcacttgcttataaaggcctttcctgacctcttagatttgtgttattccctctgctgtaggctttcacaacaccttgtattttttaatattaacctttttaatatcaacttaaaaaatcacaatcacttaatgtgtttgttttctaccaacctgtgagttacaagaaattgggtaccattctgtttctgtttatcttgtattgctaggactgggtagagtgcatacacgtagtaatgcctaaataaagacttgttgcttaactaaatggatgataatatcaataattcatttgggaattagacataaacaccaatttactctatatagtatcaacaaatcatcaaagacatcaatttggatattacaaataatggaaatccttatatgtagaattagggccgttatttatttttaaaatcacttattccacatgaaattattgtacacctctgtaagcccgaagaaccactgttataccagaagttgttttgaaatggtaggtgttcaaactatagttgtactacatgttttacagtattatttattgtgtaactttggtttaaaaatacataatttatagatcacagaaaggtatattagattattattcaaaagtattaatttcctccccatctacctccgtggcacgagtgtacttccctgtctcttgactttgggtttggatgtcacttgttttggcttgagggatgtcagcagatgtgacatgtaatacaaacaaaaactcaccatgtgcttctgcaattatgggcttgaacaattgtttttctgacattctgtttaagaactttcaccctgaaacctgctgtccccttaagatagacctgtcaaatgaatacatagactgcagagccaacccagctgacctgcagacccaatacagaaatgcatgctttttgttgaatgccgttattatgtgattgtttgttatgcataagagtttacgtatacacggagttcccatgtaaatttgtaggcgagatggtgtaaggcagatggtcacttgctgcctgaggacatcacataagtgaaacctccttaattatttgaatgcaatataaatatgtaaagattattaaggctgtgatgttaagttgttaaatagagaagtacaaaataactgattgaaacatcataggagtaaataaagaagacagtcaaggatggttatgcagctttcatcccctaggtcctcccactccaggttacctccttctaatcatagaaactggctcagctctgtgtcttacatgagtctctctctctctactttcaagtcacttgaaatgatcagagaaccagtgaattcttaactaacagaagctaactagatttgtccccaaattgtaatactaaaacatgcagagatttttgtgaaggctgtaaccaatcattaaaatatagaagtgcgcgatcttcgtttcaccatcataaagcatcaaaaggcatttttaacatgatgctataattcataatcagtaaaaattttccagtacgttggaagctgaagtatgctttcaaaaaatgaaattggtactctacttccattaatgagtgctttgaagtatgtatggagatagctttcctcattttcagtaattcttcttgttcattacagcatttaaaggggtagagggtggggagtaaaaatatcattttgcaggcacaaaaattttaactagcagcagatggtgagactgtaaagaaactgctcctcacatgaaacttacggaaattggtttctttctgatatagtcacgcatcatttagttctagaatcaggggtcagggcaatacttgccatatgctaaccctagtatatctgcctcttgctggtatagatgctacatctcaaggaatttggtttgagccaaagctgctgtaatttttataataacaagccatggtctttgctgacattttaccgctgcccaataatgagttctctctagagctggaagctgttttttaaaatttgaaataaagtttaatcttacttaagttctttggaacaacaacaacaaaaaaacaaactttattaattttttacatgcaacctagtctttctgtctgagaacaaaggaaaactggtgttatgtgtgtgtgtgtgtgtgtgtgtgtgtgtgtgtgtgtgtgtgcgcgtgctcccctgtgtacgtgcacctgttgaggtgagggtggaagaatgccatggaggaaggaacaggctggaaatttacagtccttctctggtaatttaaaaaatgtgtccacaagttcttggatatactttccttccaaagtcagagacaaattcctctcttgctgaatgtggattggaatttttgatttgtaactaacaatgggaatgtggtagaaatgacgctgtgacttccaagactaggtcgtaaaaaggacagctcctgtctggctctctcttggatcatttgttctgggaaaagacagctgctgtgttgcgaggtaactcaagtagccctatggggagtggaactggggcctcctgccaacagcaagcaccagtttgtcagcatgtgggcacaccatgtcaggggcagttctttcagtcccagtcaatgcttcagtggactggaactctttagagtatatgactgcacctcatgaggtacactgaactagaactgcccaggtaagccagtcttgaatttgtgactcacatccattgtgtgaatttataaaagttttttactattttaagctactaagttttgaggtaacggttactctgctataagtaactaatctgcacagacttattaagtgtattgtcttattcgattatcatagcaataagataggtactagtataatcattttcacatatgagagaagctaaaactaagttgtaattaaattactatgtttgctcatggggtctgtatgtgagtaaagattaaattcagctacaagcaacaggaaatgtaacataaaaatgataagacaaatacatattcccacccataatattatatatgaggaaattaagggctggttcttttgctcatggaatgcactctgggtcctagctgcttctaactctttagatcatggttactggcatgtggctttatactcatgttcacatggtagttgccacattaccagctgttgcaaccatattttggacaagaagaaggaaagggggaaaagtcaatagtctttggacagcttagcctttttgtgtcaggaagaaaaatctgcttcatgacacttctgcaccataatggccatgcttatgttgaattgcctctcttagttacaaaggaggctgagctcattggtcgttggagtgaaaagtcaggtttctgttggaaagcaagaaatgaataagagatatttctaggcaactagttgtagctgctatggcctacatttttggttattctgtatattcagataaatctttatcccactttttaattttgcaaccatacttatcacaaaagaaaccacctccaagtttcatccagatactaactttagctcaaagtctaaagattctgagtggtatacagatcacttcatcattcccaaaccttagagtaaaattaaaaatgtatgccatacaactctgctatttcatggttaaaaaataaatgggtctttatacttctagcatctacgtaatcaattaaattctccacacttaactcacattttcattgcagttaacatgaacaactcattcaagagatgtaaaattattctagctccagtattcaaattatactttgatagaaatcaaattagtttgttcaagttcttaaaaattttaaaaacttttgtatttctccagttgttagtgaaagcaagtaattgtaacccaaaaattaaatagcccactcttcatgtgagtaatatactcaaagttcattaaaatgtgtactgtattattcagtaataattatgtacaatcattgtaaaaatttatcaaacttggttaaaatttatcacagtttagttaaatttaagtggttaattaaataatctacatatgtgtactcttttctaacagagagttaatctgttcaggtcaattgcaagtaggtttttcatgaaaatagcttattataagcctaacattgtaaaaaatatcattccaaaagccatttggacattaaattctatatagtcaggtgagtacataatttatgttcttccctaaattatattaaatgccaaaaaaagacttaaaagtgagtaagtccttactagacctgagaaaatgagagtgaaattttatgaaacaaaccagaggttttataaaattttctaaagatacatcttgtatgttacaaaaatgtaatacaaaagaatgcttgaaaaatatgttgtcaaaataaaaacatcaatagaaatattacaattttaaatgaataaattttttcaaaacatagttaatcacaacaaaagagaaatgaaaacttaggagatacagtatttaattcaaaggaacattgtgaaaacagagtggaggaaataaatattaaaaagtgactaatattaggggaaaaaaatctgtatttaaaataaaaaagccaactgagggccaagtaagataagctgttgaaaaatctcatcatttcatatattcttgccaaatttctgacaataaaagattataagaatttcaggaagaaaatactgaggttgcattccagaaaaataaaaaggaattaaagaaagaggaaggtatgggatccactcaacaatgcaattagcacaggtgttcagtaaaatgagatcttaggatgaagagttatacatcatccttaaaaagcaatcagttaaagtaagaagtctgtagtctgcacaaaaactattttcaagaagaagatactttctatttatgaacttggaatctctaatgacaagaaagcacaatgcaaatatgagacacattaaaatgttttattagtttttaaaattgttagaaagttagaaaaaaaagagtgcagttgaattttacactcgaaaagctctcctctgagttgtctgcacctagcaaccaagttttatactgtcagtctaaacagacttcttgattttgcattaaataacattcgcaggatcatgccattggcataattacaagtataggtcatgaattttttcattttggaatatgtctgtagagtatggtttgggagatctaattgtggtgacaaaatagactctaaatgttatcaaaccataattttaaaggtagaattaattgataggggacagaaggggtgagaggtgggaaggaagtatttttagggtaaccaattgcctgatctttcacaatggcaatcagatatatactaatatctattttctagaagaaataaaaaatcaagcattaatttaaacttaagaaaactcaaagaagaattcctgtctaggtcttaaaggccccgcaaaaattgcaaatttgcttacctttcagatgtgtttcattactggaggtcaaaacaatgactttctttctatttctctcacactccaagcccttttctgcctctggtcctttccgttttttgtatctttgctagaaaaattctttctaaaatttttggtgtggctgtcttctttttttttattttttattttttattattattatactttaagttttagggtacatgtgcacaatgtgcaggttagttacatatgtatacatgtgccatgctggtgtgctgacccattaactcgtcatttagtattaggtatatctcctaaagctatccctcccccctcctcccaccccacaacagtggctgtcttcttatagttgtgcacgttcaactcagttatcactttccaacatttcagaggagatctccaccttgcccattggtcacttcatgccatgaattatttcactttgtggttttcttaatatttatcaccatctaatattatggtagttttttgttcaatatttcttctctcttgcttgaatataagctccaagagaacaacttaaaaaaaattctcattgggttgatcagtgataatttgttgaaggaatcgatttaaataataaaattaataatagcaatagtaattagcaatcataacaatcatgttatgggctatattatggccctccaaatttatatgttgaaaccctatcccatagtacctcaggatgtgattttatttggagatagggttttacagaggtaataacgttaaaatgaggtcattagggtgggccctaatccaattatgactggtgtttttataagaagagaaggttgggttacaaatttacacagggaaaagactgtgaagacaggaaaaaggccatctaccagcccaggagagaggcctcagaagaagccaaccgtgatcttggacttctagtctcaaaaatgtgagaaaattaatttctgttgttgtcacccactttgtaggaggctatcctagcaaactaatgcaagaactgtcacaactcaggagaagaatggactgtggatatgctaagtgacttaaatgaactaatacatgatctttcataacggaaaaaaactaggtcctgagtaaactttacaaaaaaaaaaaaaaaaaaagaaaaaaatggtataagcatataatgcagaaaactaataaacatgagaagtattaaaatggattaaagttattgcttcttagaagtagggctagaaatagacagcagatgagaggcattttaaaaaaataacaatctgtattgtataatttttcattcttggattacttgtatgaaaaaagtagatataattaattttttagttttgaactatttatggaaaggtatagtgacttgtggcatctgtatctactttttttcctaatacatttttatttcatgaggcattctggtttacagagtataaaaaagaaaataaaatggttgtgagagctaatttattctttagattttgaaaatgaagaaaacattggtgaaaatacaagacagaaaagtctgcagtaagaaacagacttcaaaggagttttccctgggaaagcagactggaaataagatataatgtaggggatgtttataaatcctaagcacagtcatgaaaacagatggagtaacaggtggtgaaacaacagatgaaatacagaatgttgatggtgaagaggagaaggtaatgaccagattcagttttctggaagggcttcaattcaatacatttgagaaagttgatggtatttgaaataactgagggacaattcttttgtacccatgttctagccattgtcatcaactgcgtagagaattcaacttttaaaataatcagtaaatacgtaatgtaaaatcgattcacggcagccaggtagcccttattttgaaattaaagagcataatcaagtattaaaggaaaacacaaatatcattgccggactaagtctggatcaaagtatttgctattacctttctaggaaaaggataacttgcagcatttttttttaaattcgggtttccatagttttttttttttttttaatataggtggacttcttttatgaagaaaaatatactataaaaatgtaagccaaataatttgattactcattataagtgaaatggaatttggagattatttatgggcagaatggagcaattatacaatataagcaaaactagataatctcagatgtaggacattattcaaaatgatttcagatttttagttttaattggcaagaaaacgtcttctttgtccctataattttaaaagtcatcatcaaattgaaactgacccaataatcccatagatagtatttttttatatataaatatagaaattgacccttctggtcttaaagcttgaaaattagatttgttttatctgagttccttcctctggaaattaccttcaggcatctcaaaaaaatatatcaaagaattgaaactcaccagatccagacaatgagatacccctcattcatcatgattgcttccttgcccctttctagctcctgttttctcacatattgttgcatttctttcctgctatataaaaccccaattttagtcagttagggagatgaatttgagtgatctcctgtctcctctgctgcagcacccaattaaagccttcctccttggcaatactcatctcagtcattggctttctgtgcggagagcagcaggacctagactaaacccctggtgtttcggtaacaaaatgattgacagtgattgagttttcatcatgtatattgattgtcttccattacagccaaatgtatcataagatattctacccttgttcactttactttttgtatgtccctggctttgacttccacggtattactgaaatattcttaataggtgaacaaggactttctcataattacaccttacactttatttgaactgtcagcatctctgagctccagatttatttatctaagtatctactggttccttctatttgggtttcctagttacctcaaaatcaaactttggaagctggagctaactgccttcttgttctttcttccaactagttgctcaaaccagaaattcaggtaatattattgactcttccaacctgttttctaacctcatctactgatcaccaattaaggtgcatattaactcctaagtatttcttctaatctgtcaagtttctctctgtccacaagtctttattctaattaactccagtatcatcttttgtctgaattatatcaattcccttctgactaatcttattgtctacaatattttgcaactccattcccttcttcacattgcagacaagacaacctttttcaaaagtaagtcatataaacatgtaagtgtgtatacactatatggatatgtctgtatgcttatgtatgtatacatgcatgaatgtgtgtatgtaattccacattttaaagttcattggtttgtctcagaataaatttccaaatacttaatctggtttaagagtaacctgtgttttttctgcaatctttatgtagtatttctgtttatttatccagccctaccttatattgtatcatctccagattttacaaccatctgtattgaaccacattcagttccagaataattatgacattcttttttattcctttagggttttatttcccaaaacatacttttccttctatttgcaactcttttttgttcttcttcaaaccatgctgtcctgctttttcacgcctgcttctggataatctcatggatggaaagggtgaataactggatctgtggactttcctctcatctcctggacatctaaggtttgcccatgggtaattattcttgtaacattaactcaaagaattgctaagagtttacttttttggatcaagataagtgagaatccagccaggggctataggactggctgaagcagttgctttttgagtaatatgtgctgataatatacaggcatcctagagtatggaggcaagtcgtatacccctgagtgaacacctaaacaactaggggtaaaaggtagagtgagctcagagctggggcttttccaagctgaggttctgcatacacttagcttgcctctcatgacaatgtttaccttgagtgtggaatgacatagactctgtgcctgggagtcataagaactctacaatgctgccattgtgcatgctctgttgtttcttttctccatccttccttaaagtaaacctggtcttactagaagcatgttgtgtctcatgaattaggctgccaacaaaaactgaagacctttggtgctggtaagcagatggtgctgcatttccattcattgtttagacttcactaataggtcacttcatctgagaagtattccctgattgatcagctgagttaaagatgaaaattttaatgtactcataaaggctatatacttctcccctcaacatttattgaattatattctagtcatttcttatctttattcctcactgcattacatggacacaatatcttattcataggtgtatttccaatgtatgtaacggtgcttggcacttagatgcataattaaatttattgattaaacaaacagctgaagaacataaatctcattgtgaatggagaatagataaatggttaacaaggtttatataactatagctaaattttctgtttatttccccattgtatcagttcattcttgctatataacaaactccaaaactcagtggatgaaaactacaataattatttattattgcacatgtgtctgcaggttggcttgagtgtgactaatcaatgcgcaatacgtggttaggacaccctactttgggctgtagtgactgggtggctcttctcactgtatgcctgtgggtcagcaggaaagctctactccacatgtctcttatgatccttggaccaacaggatacccaggccatgctttgtatatggcaatggcagagttgaaaggagtgagtgaaggcttgttggggctcttgtgcataggcttggcactggcacaatgttacttctgcctgaatatcattcaccaaagcaagtcatgtggccacgtccaaagccaaagaccaggaagatacattccaccgacactgaggcaatgggggatggtgaaacagcaatgtgatcaaccacagccaccaacataacatgcagtaattttagaatacttgatctcttttaaatacaattgtttttatattctgtatcacacaaattattttggaacaatttcaatcatttcatcacattaaactggatttatttcaatcaaaacgaatgtactgagaggctccaaacagcagccaagtgtgaagttgtcttcattttaccctacatcttccttcctgtctacctgtctgtgggcaacaggtattagctcaagaccagggggctctttcttgttcaagatcttcccttcctgactgtccagcctgtggtcttctggcttgcttaaccacctgcacagttgtgaaggcaaatcctaacactaaatccacctgcaaaaaccatatcccctactggttctgcttctctggtgaaccttagctggtatactccctcacaatgcccattgtccagtagttccccaagtcctgcttactcttttttctaagtagtaccttaatattactgaagaatacactgccacctggggatccaattataatttctcacttcttccagtgataattgagagtaatttatttctgtcctttcccactgccattagccaagaccaaaatgtcatttgctcttaccagaatgacaagaggagcctcgtaacctgtactcagcaagccgttcatatccaaactactttcttctttgaatataggaaactttcataaatacaaacttgaacatgttagcttacacctactcttgctgtggtttcccactgggaagttccttaacatgacctaaaagcttctgcactccctggcttttcctccatgtctccattgtcctttcttactacaccttaccttttcacccagtggcctgaaatgctcttccaacattctccacggtgtaggcagaaattaccccaaagatgtccatgtgctactctctggaacatctgagtatgtcatgtcatatggtgaggtggagaaaaggctgctgaagaaattaagattgctaatctgttgaccttcagaagaggtgattatactggaccacctgggtggtctcaatgttgttacaggggtctttattagtgaaagaaggagctaggagagtcaaggtcagagtttgaggcagatttgaagacattacactgctggctttgaagatggagaaaggggctacaatctcagaaatatgggaagcctctaaatgctggaaaaggcaaagaaatgcattctttcactgagccttcaaaaggaaaacaccttggctaacatctgatttttgcctaatgagacccattttggacttctgactttcaaaattttatcataataagtggtatatcttaagccaccacatttgtagtaattgttacaatagcaaaaggaaactattgtatgaaattcttccatacattttcagtttaaaatttcaaaactgatagattatctaatttttatttttaaatagaaataattaccatctattataccctgattttcattaaagaagcacttttaagttttaactttttatttttaaataatcaaatttatagaaaacttacaagaatagtacaaagaattcccacatacaatatatccagattcgccaatttttaacattttctcgtatttgtttattattctctctctccctttctctctctctctctctatatatatatatgcacaaaaatgcatgcagttattattgaaaaaaattaacataaaaacaattacaaagggcatgatctcagaataaagcaaaatcccttacgttcaataacttcacaatatggttcttacattttccttgttttatcatggaccagtaaaaacctaattatagaaaagcactggttcatggacaagcatgctgaaaacactgtcttaataaagtcttacttatacatccttatgcttactgtactagccagttctcacattgctataaagaactacctgagactgggtaattataaagaaaagaggtttaagtggctcacaatcttgcaggttgtacaggaagcatgactgggaggcctcaggagacacaattatgatggaaggcaaaggggaagcaggctcctctaacattggagattaaaattcgacatgaaatttgggcaggaacacaaatacaaaccatatcacttactcttaaatgactcattttcaggaaaaccttatattcccacactagagtttattcctcaagtttgagtttctcttgaaacctgaacttcttgatgtccccgataacattggcatactctctatcaagttccttgagggcaggagccatatttttgtctgccgtataatcttcttaggacagaagctggcgcagagcacatactctttaaaaatgtgttcactatgttaaatgattgacaaagaactgaaaaagtagagaatgtagagttcattaaaaaaattcttataattctaaaactgtatttcatattgcctcagatttatacttctaattctaatttgcccaaaaaaagtgtccaaagaaaatgcttactttaattttaagtctaacaacatgtaagccttagaattataaaaagcaaatttggagctcataacctttgactcaaaatggaaaggtgaactaggatttattgaaaaggcaccattttttggtcctttatttgtgatctaggattatctagttaaaccccccacccagtggatggagaggatacagttctgtctctttccctaatctttatcagatagctattttatttcattaaaaaattaatctattgtatctgaacatgcctgtgaattatgctttatttaaaaccctgtgattattctcacattttttctcccaagcctaatcaaaaagaagcttcaactccttacttgggcattctgattcatataaaattcctttaagtgagctggcctgggtacattgttttttccttgttgattatattatgttggtgtaaaagtgaaaacaaaaacaaaacaaaacaaacaaaaaccaaataaacagcaattactttagcaccaacctaataaaataacactatatatatattcttatgaccacgttggtgtctcctgaaatgaaaagtggttcatttaagtgtagaatcttaattgcttagttgtttaggtcaatgtgttgtctttgttggttttacttgaattatatggttaattttattcatcattaactagtcttgtcctgaaaatacctgactaaagttgtattcctttcttctaaacagctaagacactcattagcattactgaacatgttctcacttttttgtaatttattttggtcaaagggaagatcaattacattttgaaaatactattcacgtcgttacaaactttacaatcaattcaagcagggaagatgtacattccttatattataatctaggtagcatctaaggtagtgataaatgtcttactcagaataaaaacacacatttatttcttttctaacctacaaattacttgtgtaactcaatattttaacttgcttccaatatttaaaaagtagatgatttaaggtgaatcagtgaattcattcctcttgactttaaatgtgccttcatcatatgcattccaaagaaaaattatctaatctatgaagatgtattataatcaccaaataatctactgaatacatttataactgcaattttatgcattgtgaagcactgtaattgcttaatattgctaactctactctaatgccttgcaaaaagaaggtgcaaaactattcagagtatatactgactccagagaagcaaatatactggggagacagaaagaatgaggcagtattttgaatgcaaaaactagaaaatggcagatttctagttcctaaaccctttatattggttacagagtttgttgaggtagaaataggaagtgaaaatgtttctgtggaaggggtaataaaatactgttgagttttcattttctattttaaaatttctttcttgtcagtagttgtactgagatggaaacaaccgaggtctgagccatttgagagaatgacatgcagaaagctgagtgcaataggtgctcaaaaatgtacaaaatgactggtttctggaaatcattgctttattttgctgaatatctggttaggcaaatgaagggtattccctattctccacactagctgctttatgaggttggtctgtatctttgagttatgaatgcatgtgtttgctagataactgtagcagaatggtcaccatatttagggggcaaaataagaaaagtttatggtaaaattgatttttgaacatggtgatgcttgaaccttaaatgtgtgcattcctgtctatctttaataaatgagctaatctaagtatatgtgacttcttatgacacatgatgttttttttcttttctttctttttggaaactgagttatgctctatagcccaggctggagtgcagtggcatgatcttggttcactgtaacctctacctcccgggttcaagcgattctcttgcctcagcctcctgagtagctgggattacaggcgcctgccaccatgcctggctaatttttgtatttttagtagagacagggtttcaccatgttggccaggctagtctcaaactcctgatctcagacgatccgcctgcctcagccttacaaagtgccggaattacaggtgtgagccaccacgcccggccgatacatgatatttcaaagacaaaatacattgattcactatgagctgtaagatgatgttacagataattagaacttgagggacaaagaaaacatatcaatagggttgttttcatcttacttttcctgctattctcccagttagtatatggtaaacacttgatgtcatcattgaaagaacgaataaataaatgatgcaggaattgcgaattgagtgttgcacataactgagaggaaaagattcatattgtaagacacatatatgggagagaagatcaaacataaaagctgagtaaaaaaagtcaaggaggtagactgggaaaaatattatctcgaagacagtgagaagaaagttattttatgggacctgttttgcattgaaccgagcacctaacataggcagaaattgagattgtgtattggagccacaaaggaaaacacctaggttagttgtgcatactctaatgtgagaccttgaaatagacatcctggatccaagccagacatgatctccaaatttatagatttttactattttccaaaaaatgtatttatcaacttcacatgtaatatctcattcattctttacaaccctgagataggtattatgttatagccaatctttttcagagggaaagttgtgatagggaaagagtaaataatataccctgggctcccacagctgagagtggtggaaagtaggatagaacccaggcgatgctctttgaattgttgttcttaacctttagaaagatctccagaataagaaggagttaagggttatggcttctcactacttcagatgaatttttgagaaaattgtgggaggagagagatgggtggaaatatctcaaaaaggtgtgtgggcctgcaggaaaactagtgcttccatcagcgagtctcagcaggtacgagagcagcagtacaatctgtgtgggtacagattctccagacatcaggagagatggccttgaaccttcttcattatgaggctgggtaggtacaaccctgactgtggtcaagaggcaggctgccacctcatgtcagggcatgatggcatcaagagaagactgacattcagtggttggagctctgtggggaaaaaagaaaaaaatccagtaacccctttaaaatataactaaatgtcagttatacccttaaatattccagagagtatcagtacctagatttaaagtgctgaattcaatcatttctgcatcatccagctttataacaaaagcttataggttttatatacttcagaggatagtctggtaaccacagaaagacaatttcttcccaacatgttatttgcctgaaagggctttatcccccaaggatattatgctaggcagtcatagacaatacattaaatagaaatcgagacactggacactaagttgtactcggttactaataggcagctttgcagtaaagtactcaattgcttttttttagatttttttataattggactcatcgctttcaatttaaaggtacttctggaatagatatctgaaaaaaaaaattgaaaatgtaagtaagatacctttaaaaataagtttatattttcccgttttttacatactctgacatgtatataataagtgctcaataaacggtaactattatgctttctacattcaacttttaaaataatcagtttttggtttctttgctcagatacttcaagctactctagtgaaatacctttgctccccaagtcactagatggaagtgtgtcatgctgggtaccaaggagtgaggctgggtttctacggctttgtctcaatgaacaggctttgtctctaggctggaacttctctttactgccctaggcagtagaatgaagacagaagtgaaagcgatgaatccttgccaataattttgtcagacctcatgttctcttgtcttttaaaataatcagtcgtacagcctctgaaatgaaatggatggtagggtttgaagtcgacacaacagaaaaagagaaggttgtgtggatttacatgggtattttatgcagacgtgcatgtgtttgcttgatttatttggcattccaggttatctgccttctgcagggagcatggttctcttggggagtatcctccctcatctgtatggttcttatgaagctggaagggcaataccctttcatggtaaagagcacatggctgtgaggtggattcataaccaggtgttaatacataccgtgtgaccttgggcaacttacttaacgtctttgtgcaccaggagcttcattttaaaatggagataatacagtaccttccttattgagtcatttgtttagcctggatttccctcaaaagtagagcctaagataagggattgggtgcaggtggtttgcactgcaaaggaatctcaagaagtggaagcatagaacgagtgaaacagggagggagggaaacctaatccaaggttttgtatccaagctgttcatggcagcggacactgggtcttgaccttgttgcaggtcctttgaggactgtgcagactgcattatagaattgtctccaagggatcaaggaggggaggagtatttacataaaacctcccattctgtgttgggcaagattgacccattaaagtgttccctctcttacatacgtaggtttgcacatgtgtaccagaatatttccataggagactctcccagctctgatacagaagcccaggatagaagttactgttagagacaagatgttgtcatgttatatctgatagctgccaccaactggctggagtaaaagaaagaggacttggagatttgacaggagatgttgataaaggattaaatggaaaaaaaatatgtgcaaaacttctaggccattgtctggctcagagtatgtactcaattcatgttaactagcaagcatgtgcacttttctgggcagatatatacataaatttatatgtataatcatatatatataattatgtttttacatttccttctcctgttatatcatgcatatattacgtcttaggataaaattgtcaaagcttcacttgaccatgttccaggaacaatactgacagtttatcactcctatatcttcacagaagggagaattaattgtaacttgagcaatgtccagagatttgctagacttgcaagcaagattatccagggaagagaagagttaacaagttgctatggacccaaagttgctaatcagtacatgtgtccgaacaggatctcttcctaacctccatacacacacagactctcacacacacaaatgggtgcacacgcacagagttgagctaacaacaagttttagagagtatgagtcgtttctcagaaaagttttatgactgctttaacccacaaacaaggcaagcaatttagactgacatttagacctccttattttcttgatttccaatttcttcactgggaacactgaacttttcctaatcattgtggataatgaattagtaagcttagttttaggtcattcatgatttcttttcttaatctataattgaaaaattacttcctttttgtctttgttttttcctttgatgcttcctcattgtatttaaatttttatttatttatttattttatttcattttatttttgagatggagtctctctgtgtcgcccaggctggcgtgcagtggcgctatctcggctcactgcaagctctgcctcctgggttcacgccattctcctccctcagcctcctgagtagctgggactgcaggcgcccaccaccacacctggctgatttttttgtatttttagtagagacggggtttcaccgtgttagccaggatggtctcaatctcctgacctcgtgatctgcccacctcggcctcccaaagtgctaggattacaggcatgagccactgtgcccggcctaaatttttatgtcttatgctgataaaatatgtagaagcatataggcagatgttcagcaagatgtctgtaagtgaggacctttttaaagtctgtctttcttacagaagaccaaggaatttgatatatcatctgaggaagtaagtaagcataaggaaaataaaatttttagtaaaagtagaaatgcaaatgaccatattcttttttttgactcccaaatttttcaggtggtcagaaggtcattttaaacattttaaatttatttttaaattttgtaggttgtgtgtacattttctgggctgtctagtgagtgttaaacatatgctttataaaattatcaaaagccgaactattgatatacattttgacagatcctttttggtttgttaaattaaacattttgactctttcgtgtgttttcttgaaaatgagagcattggttcagtttttgaaaatctcaaatgtaatgagattggttcccagcagaagtggtgggtaagaaaaaaattaagcttgtcaagtcattttatgaaagatgcagtaagggagagttgggtaggaggactattcagagctgaataaaatcagctgcagcatctgataaggcatttcaaatgtttgtggttttatgctaaatgctaaagagatcaggtgtctaccccataatggatttacctaggctcctcacagtgtttttaactacagcagtgatcatgaatggtcatatatctaagcgtaaatttaagacttgggaagtttgcgtctggtgttaagagtgacttactgtaaataaggactggctgcccttgaacatttttagagcatgtgtgaatctggtgttaaaactagcaaaagtcattgcccgtttttcctttgcaagtggaaaaatttacagtatctctcttgggtctcttgagctatgcggagatgcgcaaatctcagttgtagtgagagccatacactggctttattagtcttatgggaaccagaatcagcttcactgactgggagatttgctcattttagaaaagtacatggacttttgtatttaggataccctatattatcttaattgtgactcttttaacgtacttattgcttaattcatgggagtttcttctcagtttttatcttcttatctctattgcttggatttgaagatacagcaattaggacaaaatgactgaccttcttccccagggtcagcaaggaaaaacaatgccatccagtgaaatatttgcattctattaaaacaatgatgatctagattatttaaaatagtaacaataataactaatataatgtctcattttaaataaggtggtattttccaatagattttatacactaatatatttaacttatagttattcatatttattacatgaatatcgtaggcaagatgctgagaaaaaagcaagtagagaccttgccttaaagatacttatagtctgatatggtcaatgagacagtttaaaaatagccacatacccaaaggaaatgcatatatatgttcaccaaatgccataaattaaatattcacagcatttactccatgatagtaaaaaactagaattactcacacatccatcaacataaaatgaattactaaactggcatagttgcatgatagactacattatagccataagaataaataaatttcagccatacccaataacatcgaggaatcccaaacttgttatgttgagtggaagaaggcagatacaaaacagcataagctgtatgattttatttatgccaagaagagagtaaaacatttatgtgctgctggaattcagtaaagagttaagtgttgagaggtgcagtgactgggagaggataggagggggctctctggcatgctggccatgttctctttctttgaaaggtgttctccgtgttcagtttataaaaatgtattaactttgcatgtatgatttgtgaatttctctgtataatatacttaactgaatttttaaagtaagcagtatcattaaatagaataagaaaagacctttgtggataaaatcttttgtaagaaactgggctgtatctaccatgtgctactaccttagttttctttttgtaaagtttttttttaattaaaaaaaaattcatttgccttagttttctggagtaattgggaggatttgaagatctggagatagagacagtcctggaataagaaagcgtataaaccaaagtaaaagggtgggaaagtattattgagtaacagactgaatggactttcaagtacttgaagagaagttggaaaagtacaaagaggaaagtattgtgttaggtttcagccagacaataaaatgttttaaactatcatggaatatggtttctatttttttctttgggtgatgggaattgatgaaaaattttgcactatggaatggcatcattaagattagatatttgaatatctggcaagtgagcttaggggatggattgaaaggcagagagactgaaggaggaaagatttgaccatcttttctctgcagtattacagaggattgtcacgtgggtgtgcaacagatgacaatcagcagtgggacagtgactggtgcctaaagtgtgctcaataaatatttactaaatgaataataatgtgaagcaataaacaaaataagaggatttttgcatttgactctgtaaattagcattcttaagcaataagtttgcgttttcaagtggttcatcataagcagaatctaggttttgtttttgcaaggtaatgccacttaaaattgggactggagtacttggtaaagtctttcataatctgtatgtgatattcagatcattgaatcttatctgtttggaatccagattgtgtataggattcaataataggccacgttatactgtctttctgccaattccttcacaaggccctctgaagtaaaatataaactttcctccggtaaaatattgtacctctttcttggttattatcctggatagaagatctacagttatcatatcctttcgagtactttggttaaaaattattgacattataattcttcagtagttcttgaactgaaagttggtaattccaacttttttagaaatcaggtcaatggtagtaagtgctatgtctgtgttttccctttgaattctggcttactttttaggatttggtgtcagtttttaaggaattcatataggtattgaattatgtggtttcactattcttagttgtgattactgggaagaactttggcacacctggtggtaattggctatggtcatttgtctctgagaatggttagggggatgctacagctaccagatccaagtaaggatgtgaggcaggtggaacacagacaatttatcagcaaagtccgtgggtggaaaggatgcctggatcatctaattcttttgagctagtgtttgctgaactgaatctagtagataattatcttcacctttgctttatactcctcgacacagcttaattgtaagagaatgaagaagatagatagaatgtctagctgatttgttacatattggtgaacaacttcaattttagctcctattttaaactcttccatcctttccttctgtcatcacttgcccacttccaatccaacttccacattctcatgaatattctcttttaaaaattgtattttattggccgggtgcggtggctcacgcctgtaatcccagcactttgagagcccaaggtgggcggataacaaggtcaggagatcgagaacatcctggccaacatggtgaaaccccacctctaccaaaatacacaaaattagctgggcgtggtggtgcgtgtgtgtagtcccagctacgagggaggctgaggcaggggaattgcttgaacctgggaagtggatgttgcagtgagccaggattgggccactgcactccagcctggcgacagagcaagactccatctcaaaaaaaaaaaaaaaaattactttattatgccacttatctgctgaaaaatttgatggaacaatttgggaggcattaaccattttaactggcttttagtaagtgttaatggtttggtaagtttttttgattcaacactgagaaaaatccattactaatggaaagctcagaaataacatgaccctaaaaagattttagcttagttttgttttgttttgctgattatattttaaactatccactcaatgtcaaggtcttcagtagtgctaatgaattagttatctctgaaacgcatcctggagttcattgtaaataaatactgttgcaatttaaatattgattcaggaataagtgcttgagattgcaaaatatattttttaaaagaatgctgttatttttgtttctttatggtgaataaaaaaagcttttgagtttgaatttactcatatgagagctaaaaacttttacaatacatccccccaagaaaatatattcagaatttaaaaagggaacacagatattagaagaaatatcagattcagtccagattaatcacagaatgaatcagataactattctttcacaaatcatgctatttctgaaatctaattattattaatgccaacatgccatatttttaatggaaattcttttaacattttaaaaaatcttccatcatccatacaataaacccataaatgtggaagcatttttaacatgccattatttagaatgttttaataataaaaacatctgaaatcaagttttacttattctttcctgtaacagagagctgacatataactttaaaagatatttgccatgcgggaattggggatgttgaatcaaagaatattcttagattgtatataatctcttttataaaaaaagtatatcttgaattcatatttttgctttttcaaggtagattttgctctttcttttggcatctatttttcttttgcaaaatgaaagaccgcaaaatatttgcaagtcatggtttcataagatatgattataaaaagataagcaatgcaaatcctatgcatcttgttttccgtacctttttaaaaattttcttttgcctttacagatttactttcttacactccctctaaaaatattttctgtttaagaaggggaaaaaaatggcttgtgacaatttgcataatatgttaatgtggatgtgcatctagacatctggatggcattttaatatctcattctcattcaaggaattagacctcacacagatggtagagacaattttaagagcaatgttgtaaacaaataaggcgtccaggaaaccaaacacactccaagataggctttgccgccaaagaagctttttagtgagatgttttgactacaagattgtacagcccttatcagtctctgacaaaaggagagggaccagcaggcagttttcctatgcaaaagaaaagaacaaaaaatgtgccaccagtcatgaattttcaattttgaacattttaaatattaaatatattttatacacatatacagaatatatgtatgtgtatatatatgcatgcattcatgtgtacatataacatatacatgtgtgtatgtacatacatacaagcatatattttaataaagtagacctatacaatttaacaataagttgacctcttcctcccttctgttcttagaaataactggagtcaaacctctgcatattaaaaacacaggactctggaattgtttggtctacgtttaaaacgcaatccaccattaactagctttgttatttgggcaggtgactcattctcttgtatgtgttttgtcatctgggataataatccttgtgtcacagcgttgacaaaaacattaaatgcattaattacacatcaaacgtttagcacgtgccaatgcataggtagcactcaatgcatgttagtagttatcattgtttaatttttactactttttactttgctttatttttgaatctggccatctctaacacaaaaacatttgacttgttcttttacgtagtaagaaaagatttctgggtctcctgggcttgtgacaaggacccagtctctggattcagacagactgatcgttacacttgagtatatctcataccaactagactgtcatgaaaactctgtcagagtcagcttgcttatgtagcagaggaagcacagttccgaattcactggattattttgcccatgtgacaatgcacatgaagtaaatgcttttggatgtgcctatttttaggtcacatgtctttttactgagatttgcatggtgacttttacccaaaggattgcacatccagcaaccatatttctcctttctctatttctctgatactcattgattaatttgaacgaattaagatttgggattctgaagtgtttggctaagcttttaagataaggatgttgcatttgacgagctcgctgtcatgtttgtccttaattatgccaaaagaagtaacagtttctcaggacagacagccagaaaaggagttagaggggtgaacatccatctagaagagagagaagacactcagcatggaacagagaaaagacagagtgccttttcttgggttccatataacttccttttcttcaattccatggcacatcttagattcattgaaattgacttttgtatgcatcttgtatgtgataggtttctttcatatagctaaactatcccagattaagatgacaagtaactagatcattggtgggacggtgtattcagttagcctatgttgcctatagaacaccagtgagcattagcagattgcatactgtaaatccattttgaagaccacatctattgtgaaatttggaaatgaactgacaaaccagggaatgaaaagagcagggatggcaaatctttggtatacccttgacagacatcactaatcaatcatagcttcttttcccttgaatacagagaaagtcttggaatgcttttcattgaatgatgtcatgaaggcactcaatttcattaagagaagtgtgggatgtagtatgagaaataagtcaaagcaagttgtttaggactaaccctgggaataactttctaaatgggctatatattccatgtgatacatagggcaagtatagtgtcttaaaggagatgtacaaaatgaacacaaaggatgcaaaaaatgttttacattgttcatgtttttaagcaactaagtgagatctgaatgaaaaggcaagttcataaaagcaaaacaaaacaagacacatcatattttattaggggccaagtaaatttaacagacaatgagagcaataagatgtaagaggtcatgtgccctgaggacttggaggctggccagggctgataggttgtggggagagcattataaagctgtgcatgggcaccaatgagcaagacaagttgtctggagcagacattcataccggaaaacaatgggaaatagaattgacggaccaaacaggaaataagctgtgaaaatccttgaatccatactaagaaatgagaacatctgtaggcaatggagaacatttggagagttcaaatatgtaattgtggatattagaacggagggggatcctaagagatcagttggcctagcccattgccttaatgcaggtgtgttcatattattttacttgatagaaatagctgattatttatgctcaaaacggaatttctcatgatagtaaggggagaagagatggcttagttctttattgaagtttatatgattgtattagtatattgtagtttattgcatatataagatcagtatacacttacagcagggtttctcaacctcagcacttttgccattttggactggaaattctttttttgaggcaagaggagtctgaattataggatgtttagaagcttccctggtctctgtctctagatgccagtagttacctgtacctctagttgtgacagccaaaagtgcatctagatgttgctaaatgtcctctgtgggtcaagatgcttttttcagacattactaaaggtcctctgtacattacagttatccctggtggagaatcactgacttggagcaagaatttcttttttaaaattgaaatagagaaagcacttgcctagagttcaaaacagaatattgacatataattaggtagtgatttgcaggataagttagagaaggtagaaatgggaggcaatgagaatatacaaaaatgatcatgtcagtctagaaatgaatagatgggcttataagctagagctctgtggctctgatagtaatagaggcactgatagtaatagaatagcagcagttgtaatggtagtagaagcagcattaattgtgcagtcataaaagtacttctcacaattacctttagaaatgtttgctactatggttatccccatactgccgatgaggaagctgaggtttagtggtcacccatggcaatggttgggattccaactcctatctgtcttgcttccaacactttctattgcttcatctctgaaacaggttttgcattcaagtggttgacaggaaaaagcagtctgaatggtcacactctctgttgtttgttaaattatactatccttcccaaaatctcactctctttatttcgagatgtgaacaaaaattgttccccctaagaacagcataggctggtacaacttagagccccatctgctctggtttgttggataccgccacattacattaattagtagagagagagcattcacatgcataatgtgcccatttttcaaaagcatattttacatggttgtgtcttttccttaaaaattcattacaaagataagagtgtgtttatcacataaatacagccaaattatggcataagggagctttaagaaaatagataaaagaagttataaaattttagacattataaaatatttgttactgatattatgctatgtttttcatgctatcttaaagactttttatagatattattctatgctcacaactagattttgcaattccagcatgcccatgaatggaggaaacctccagttagcttgaactaattagcttcttttgtgaaatgtccaagctgctaatttctgtccttttattttaaaatagaacaccttttgtttatttctctgagacacagatttctcctacaactccaagtaggataaataaaaggagaaaaactccagaaagaactgtttggagttggttagaagattgtccagatgatctttattttaatgttgggaaaatatagatgcctatcttggaatcagcaaataaattatactcatattaaatttcattctaaatttctgactttacggtttattttatatatataatatatataaataaaattttatatatgtatatcagtaaacatatgaaaccatgcatagtacataaaaactaggttcaagtaggaactcagtttactttgtttctctgagctgtagtttctcaatatgtgaggtgggaataaaataggaacttcacaggctgttaaatgtgccaatgagagaatgtatataaaatgcttacacaatgtctagcacaaactatattacatatggtgactctcctatggtaacagctatttaccaatctctgcagttgccttaatggaattgtaacaaaactggacatgaaaggctattgtaatttcagcccaatgcctaacattcgtggaaaaacatttcagcttttctatgcatagcatatttttctccaccaaacatctgtgaaggtgattttcatttaactatttaatgggtcaataacctcccttctattttcatattccatctacatcatcaaaaaagaaattttaattaccctttggataaataataggaataaaatggcatgaatcaaaacacagggtttatgcatattctctatgaaaaactgcactaaaatgttgttaataaattttacacccattaaggaagtgtgtgagtctacctggtagaattaaagtatagttgaaactattgctgtgggatgaaattatgctcactttaatacttccgatatattttctttgtactagaaaaaaaacagatattttaaaaatgccgcatttatctttatctctctgtgcacatgaggatttcataccttattttcacttgagtttctttgaacaatgaaaactttggaggagtgtatgctatattaggaatttattagatttcatcaaatggcaggtggttatgaattttgtttccaaaaaggagacctgagggatattccatattaagggttttattcccttttggtggaaacatgcaaatcatttgtttttgctaaaaaaatctatgaaacatttctttcattatttcccttgggaatggcagctcgctattattcgtaattgtaaatgcagttgacattttgaagtttatgttcatgggaataagatattttttggacattttagtgatgccaagcccaggaaaatctagttattttttgcaatacacatgtatatacagtatgttaattggagtaacagagatggccatttcaaatttggctctgttattcatctttttttttggaggcaaagagtgttggtaagcgaatttaaccagaagagcagtagattcttttgaaataatgacatagtggaaaataaaaacacatatacaccaagaaacaatttgtgagctaaaacatgattaaatttaatctgttgccataaagtagaaaatgttcgaaacaaggaagactgtgtactttcagctaaactgaaaataaaatgacaacaaaaaagcaggactctccacaattcaagacttgctgcttctatgatgccacactcttgattatttacccctgctatatgaatgagtgagtgttaacactgatgtattacacctaaaagactggaagagcatctttgattccattccagtccaccacgtcgtgctagaaccaggacatctgccctccatagtaaatctccataaaattttactgaggagaaaagaatcctctacatatgaggtagagatgtgaatcagacaagtccttaaatgcatgattcatctaactgcctctgaataattggttaacttcagccacctgtatatataagcatgtaggtgttcaatgccaccacacactctccacaaacaacaactgcccagggttgccaaaagataattgcatggtggcaaaatgtgctgcttgaacagtgccaacgtaaaggataaaaaaccaggaaccacactgtaaggaagtgaagactgtattatactaggaattccaccttagactccaatctgaccatctgaatctgaatcggactatagtggatggactgatgctaccctgcagccttacttccttaactttgtttccccaggccctaatataaaccccaggcaaacaggcatacagctgtatgcatttggcagattactatccatttcattgttcagttgttctggaaaggcaccgaatgcaactgaagcctggaaacattaggaaaaatggtactgttcctgatatccttgtttcttcctaaatgacagttgaaggtaactttcctttgtacagttctgcctgccgttagcaattttccaaaattaaataccatattttgtgtttgataggcacagctgtgtctgttaccaagggcaagcccacctgcacagcactctgtgttcatttatgtactgagaactttatttagaacccagttttacagaaaaaaatcaagttgggtgaaccaattttgagggcagtgaattcttgaattctcctttggggttatgaaaagggaaaatttatttgcttctgatagaagtaatataggcctagtggatatcttagcagtgcagaaaataggatgtaccatctacctatattaactgtgtgtgcattaatttctgaatctggttttaaaaactccattgtgttctaaacctgatagtttggaaagttgtaagaccgagtctagagactcatgttaaaattctaaattttggtgcaagaggaatagctctcgtttttgcccaagccactttatttttcaatgtcttcattattttatctgccaattgaacccatcagagtagaggaattcccagaattatttgaagctctgaaagttctacaatttgggctagagaaatggaatatatgaattctaccaattaagacaccaactcttcaggcaaaattaatttaatacttggggtatgatgggttgaccctgaatatttacaagatactaacactggaaaatgttagtgtgtcacatgggacaagagtctgttaaggtgttctacaagaatgggaggttgtgtggttaaacatttggcatgcttggcacattttttccctcttcctggagagttatagtttgcattcacatttaaaggatctgagaaatcctgcagaaaagaaaattatgtagctttgtttaacccaatgtttcccaaacttagtggactttatgcattcgacatctttcctttgctcttccaaattagtcttcagccttccctaccctgctctgtgttcatgaaactgacgtgtgtgaattctaacttggagttttctttctactggctcctggttgtttggctgtcaagagaaacttctggaggaatgacggcaggaaaaggtatctgaggaagagagaagtaaggtgcttgtttccctggcttcctctctccaagctgactgcatctgcccaccagaggtcacatttcttgtcacgtgttctctccacacattttccttccagattcctgcaaactcttatttccctccatcctttcaggcatagtctgtaggttactgccttccttttcaattttcctataacctgcccacatctattcaaatagtgcttgttttagacattcctcaaattaccaaatttgagtgtcatcttttttctgcaggaagtctgagtgatatatatacacatggtatcttttttaccttgctgatgcatgccatttttatggaaaagcaaactgctatatttaaagtgaggaaaattattttggtatcaaagtgtctgaaacactgttgttgcttgacttgctaactaattattgtccgaacccttctctatgcgtagatatatcctaaaaccaagtcagtgaaaacaggtccttctgagtttattttaccattgtcagctttctttttgctctcagtgggcccatgagtgataactatctccacagttagacatcagtaagccatgccatttacctgatttgtcaacagacatttgtgaagcatgtttgtgtgtgtgtggcattgaactagatgctgagaataaaaaggtagagaaagattaacatgattcccagggtatccaaagcagcctgtatgcccaccaatacaacaataataaaatgtgaataccgataataaatgttataatacctaacacttacatagctctgagtacaataagacatttatatagtttgagtgctttatctgtattaactcattcaatcttcccaacaaccttatgaaaagctactgttaattatctctatttgacaaataaaaagatgacaaagtcaggctagatgagtctgttcatgttcacatgtaattaagtggtgggagtggatttttagtccatgtagtctggtcacagagaaagtataattaaaaaatgacaaggagatgtgcaataggagggcttggctcaattgagatccaaagggcaaaaaagtaaagagagaagagtgtttcagaagggaagaacttgtgcaaagatactcttaaattgtcttgacgctgtttcatcagggcagacgacatacaaaaaggccagtcaaaatggagttgttaagaggtggtctatacagatacatcagttaagtacacgcacttatattttctttgctgtgctattcacgataacaaagacatgaactcaacctaggtatccattagtggtggattggataaagaaaatgtggtacatacaggtaccaaggaacactatgcagtcataataaagaatcaaattatgtccttttaagcaacatggattaagctgaagtccataatcgtaagtgaattaatgcagaaacagaaaatcaaataccacatgttctcactaatgaataagagctggacattgagtttacatggacatgtagatggaagcagtagacaccggggactaaaagaggggagagagaggtggggaagggttgaaaaactacctactggatcctatgctaactacctagatgacaggatccatacccccaaactcaggattatgcaatatacctatgtaacaaacctgcacctgtatccccccatatctaaaataaacactaaaatttaattaaaaaataaattaaaaaaatgaaaaaatatatcagtcattgactttattgccctgataacgtagcaatggcaacttcacatgttgacttaaaactttgattgtcaacctttggtgtttgcaggatacttaaaaaaactggattatttaatgacactcttgaaggaattaaagtataaaaaagttatagaatattgaaaacatatttccatacttattgaattagttgtttttaatttgaggagaaccaaaaaactctttactgtcctgaccatattctctgatacagtaataatgcaaatttcttacaatttctggcatatagggcatctttctttaacactagcatgcctttacacgaagccttatcacttctttgcagcaacttgttccacaactcactgagtgtgcattgttctgccagagacatcactgtaagagtatgtcgtgtcaaatgtagcaaaaattgtttttatatggtatcagttataaagtgcttttgaggactgtttcttgcttccctgagaatgctgacaagcagagtaaactaagtgctccaatttctaggttcggaaaattacccattttagtcagcttctgcagggccttctaggacagggcacagcaaaaacaccacttctgaacaccccaatcccctggaccacatctagaggactacagaaggtaagagggagaattctcaaagttgtagttatccataatcctaccccttcttatcaagaggaggagaaaggcattgaactctctctcatccctgccttttacagatggttctggaatatggacaaaaggaaaggagaaaaatggctaaggtgccagaggaaattcccaaagcagcctgcattccctcataaatcaaatgtataacatggaactcacctgacacttatatcatcttttcagtgctccaatggtcatacccacaaagaaaagggatccaggcaacaagaggatggagggtagattggtcttggacccggagtttaggtcaaggtgatgttgaggactttgagacaagagtgtacattttagttattgaattacatcacagaaataatcacaccagcctatatttttcaccaaaaatgaatgaaaggaaaattatatctgttctaggcagatggaggtcaaaggctgctctagatccagaatcttaacctatatcaagattcatgttcgtgcatagctttattgaaactcttggctcaaattgacttacttccctaatgtcaaaatttgagagcccatttgtaaaatggcttagtgtaatgcactgtggatgatcaatcaagagtcactagtctgtgttcctattggagaaaataatattgcttttctgtttacatctgtgtaagaaatttcacttagacatgaatgctaagaaaaactacaatcctttccaagcaatagacatatccttttatgtttcataaaattatctcttcatctgggatagtagaagtttttattcaggcttgctttatgctttctcaaaactacggttatgtttaacatatttgctttatttctagtccatgcctttgtcatattttatgttaacattttgtgttgaactatctagactatctacctttatctatgtatgtatgtatctatctatctgtctgtctgtctgtctgtctgtctgtctgtctattttattataccaaaatcttcttgcaagtgttgatgtctaaataaatttgataatgtttattagataaccttcatttgtaattgatttgctcatctgttatccatagaacttggaagcgtatttgtagataaaagttacagatgtatagatacattgatagataatgcagttatataaaagtatatatattaaattttaaccatataaatatgtaaccagacatatacagattttagtaaacttcttttgactttttatttttaaatgtgaacaaaaatagttggtgataatggtgtctgaatctgtggtctcaattataatctcacaactccaagttcccaacacagttggaaacatcatttatctaccgaattcttctgttggtgtttttctcccagggaagcagagaaaataaagagttctctgcttttaatgtttctgctttttatatttgtcacagtgctctgcttttagcaaacaccctgatacactaaaagtttgctttttatttaaccttaaaaatttctttggtaagcttgtcctaaaaacttgacccagaataatacaaatgccattcaaacatctatttgtgcatctctttttttttcacttcaactgaaaatatactttctctaaaatgtacatttgcaataggaatatattactgatggtggaaataaatttccatgtaaattcatattgtccttctacatagtgaaatgacagctttttggaagtcacgtgcacacagctccccagggaatctcacatctattatccatttcatgcattgtgaggcttttatggcaatgtccatacccttcattttagatagatctatcagtctctcggtactacccatgcactttggatcactaagactcctcctgagtagatgacatactaatatgtgactagtaattgaatttttgacatatgcaaaaatgttgtaacatagataagagagaaagtgccataaatagatatctaaaagaagggaacagatggcctctttgtgaagatgtttggataaagccaaaaaatgacaaacagatggtttatacgtatggggtaggttgacagtggaacctgaagctggtggggcataatgcacagagctccaacttttcctaaaaaaacctgaagtttggtctataagaggaaagtattacagacttcataaaaacatagacaattgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcgttgatctgtctgatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttgtctcttttgatctttgttggtttaaagtctgttttatcagagacgtggattgcaacccctgccattttttgttttccagttgcttggtagatcttcctccatccttttattttgagcctatgtgtgtctctgcacatgagatgagtttcttgaatacagcacactgatgggtcttgactaaccctatttgccagtctgtgtcttttaactggagcatttagtccatttacatttaaagttaatattgttatgtgtgaagttgatcctgtcattatgatgttagctggttactttgctcgttagttgatgcagtttcttcctagcctcgatggtctttacaatttggcatgattttgcagtggctggtaccggttgttcctttccatgtttagtgcttccttcaggagcacttttagggcaggcctggtggtgacaaaatctctcagcatttgcttgtctgtaaagtattttatttctccttcacttatgaagcttagtttggctggatatgaaattctgggttgaaaattcttttctttaagagtgttgaatattggcccccactctcttctggcttgtagagtttctgccgagagatctgctgttagtctgatgggcttccctttgtgggtaaccggacctttctctctggccgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacactaatcagatgtagatttggtcttttcacatagtcccatatttcttggaggctttgtttgtttctttttattcttttttctctaaacttcccttttcgcttcatttcattcatttcatcttccatcactgataccctttcttctagttgatcgcattggctcctgaggcttctgcattcttcacgtagttctcaagccttggctttcagctccatcagctcctttaagcacttctctgtattggttattctagttatacattcgtctaaatttttttcaaagttttcaacttctttgcctttggtttggatttcctcctgtagcttggagtagtctgatcatctgaagccttcttctcttgactcctcgaagtcattctccgtccagctgtgttccattgctggtgaggagctgcgttcctttggaggaggagaggcgctctgctttttagagtttcgtttttctgctctgttttttccccatctttgtggttttatctacttttggtctttgatgatggtaatgtacagatgggtttttggtgtggatgtcctttctttttgttagttttccttctaacagacaggaccctcagctgcaggtctgttggagtttgctagaggtccactccagaccctgtttgcctgggtaccagccgcagtggctgcagaacagcggattttcatgaaccgcgaatgctgctgtctgatcgttcctctggaagttttgtctcagaggagtacccgctgtttgaggtgtcagtctgcccctactggggggtgcctcccagttaggctgctcgggggtcaggggtcagggacccacttgaggaggcagtctgccagttctcagatctccagctgcatgctgggaacaccactgctctcttcaaagctgtcagacagggacatttaagtctgcagaggttactgctgtctttttgtttgtctgtgccctgcccccagaggtggagcctacagaggcaggcagtatggcacactcaattcatcttcctggaaacctccatttacattttattgttcaatccagaagtaaataacttacattcaactattgagaaaaattttaaatgtgaggactacagggtagataaacttcaaatatctcaactggtacccagctaagttcatgtagacttaggtttaattttttttttttttttttacaatattggctttgccttgttttatttgctttagaaatgaaatcttaagaacgttgaaaatatgctggcttatttctccctatagaaatatattgctagttatttctacttgtataaaatatatagggtttctacttgtataaaatatatagggttttttgttgcttgttggtttgttttttagaacaaatggagtcaatgagctctctcttcttttaggtagcactttccatgttgaataattctcaacacaaggaaacaaacctgttttctttttaaaaataattacacaagcaggtcttgaaaaatttagcttacacagtgcagtattatgtagatttaaatgtgtcctcatcctgcccactgctgtcttatatttattttaaattaccattctattctgatttttttttagtggtagtcattgctatcatttcaacatacgttatattctgtcattttctctggctttacttgtgtatacacgtgtccaaattcatatatatggattttattaaaaccataatttaataattttgtttacatgctttttttctgttaacaatagcttaggttttatacagatatccctctcattttgattaagaactacgtaatatttcctagaatgaaagtaccataatagcttattccattaaaaaatctgttactcaccatgcttcatcatgcatacatgaagatatatatttatggtcatgtgtagaaaaataaaagcagaaatattaagtgaaattaaaaatatataacctttacaagatttctaatagatgctagcaaattgcatttaacaaattattttctctccaagactgtaggaaaatgacataaccccgtcccctaccagaaatgaatatcaaattaatcttgattttacaagtattagtatgcagatataagggttgttagttaataacaacaactgagtataatttgagctgttagaaaattattttcttatatctaaggtaaaattttcccttaatattgatttattggtcttagctctactcttggtatcaaagagaaaatgcttctattttgtttatgtaacaatttttccacatacaaagtagtcacatggtaaaagactgaatagactgctaaagccctacataaagagcaacccatatgttacctgtgtcttctatggttacttgtgtcaaagagatttcaataatatggtgcaaattttaaggggtcacatttatttttcccaagacgtgatctgtgtattcgtgttgccttcacaattcaggcaagaaggttgctacccagggcttttctttatccccatttctcccatcacccccgaccagaaactatattaattacacacgcagatcaaaatcaccaggttttatttcagttctactttacttgccctttggaggccaacctcccttatttccacccatcctttttgtttcttcctagctgctgtcattttcttttcatattttttctattaatctccatatcgttcacggtgtttatcatgctattccattgtaattaatgtctctgggttatgaaagagcaaatttaacttctgtttcacttagatgtgctttatccctgagtaacacgatgcgtgaaaggatggacttggtggatttggaaatggagatgagacccataatgctttgcagcaaatatgcctgattctgaatttgaaaactcttttagtttagattccaattgtatcctaaaataaatttaggttccacagacattttactaagtgtctgctttgggtcaggcatagccccaggaactctcacactgtattgttacgttaacaaaagttattaagtgtatgagagtgaaactgtggaatgaaaactgcatttcgtatcagagagaaaagaaacaacttacattttacatattaaaatataaaaaatccaatattttacatgtgaatcctgtgggatttcatactgcttgtatacattagctcaagtgatattaattgcaatatggtggaatactaatagtttcatttttgcagaagagaaaatcgagtgttacagatgctgacatccttgccactatcctacagctattcagtgacattccagggctaggtttctggtggttttctttttctctggcttccaagagaatggcatattatatcttagttttgattgccttctcccagtagtctccgtaatcaacagaagcagcaactctacttactagtatgcataggtttgtgtttttttaacgaagtaaatatattttattgagtctttccaaaatctttgtaattttccttaataaatcaggaaagaaagcattgtgacttttttttccaatataatcctgtatttccatgaagatggcttctttcagtgtttattttgttaagcacatagtctatacatctttgttaaataaatgaatatggagcttttatttttcataaataattttatgcatggttccaaactgacctgtctgtatatttttatcacctcaagccacaatatattgatagtatttattgagtatccatttgattatagcaccatatttcctgcatatatgtttttattcaatatttgatacattgggagaaaaaaatgaatacattaaaagtaccgactgttttatttcttccaatatatctttttctatactgatatagtttatagctttataaattctaatagctacattctttttcattctcttgataaactcttttgattaaacattttgcaattgttgaacttcatagttgatttttttttttttttttttttttggggagatggagcctctctctgtcgcccaggctggagtgtagtggtgtgtagtgtgatctcggctcactgcaacctctgcctcctgggttcaagcgattctcctgcctcagcctcccgagtagctgggattacaggcccctgccaccacgcctggctgatttttatatttttagtggagacatggtttcaacatactggccaggctggtctggaactgctgacctcaagtgatctgcctgcctcggcctcccaaagtgctgggattataggagtgagccactgcgcccagcctcattgttgattttttaaagcagggactctaagtttgcatgtcaactatagtaaatgcatgttacataccctttttccattttttttttgcttatttttagtttgttatatgaaacctgttattgatataacctcaaaaaacttgcatgtgtctaaagtatgtttacgtatatttacagcagtggtactgtcattaaagattttagggcagagggcagtttgcatccttatagatacaattacaaatatctctgttctttcttttgtaactacaaaatgccttctgaaagtaaaagcatggataatagttctaaaggcactttgattattttttggaatatcattcctgaattgagctgtgtgcggtatcaaagaattgggcttttcattagtcaggatgtttgtcctcaattgtttccttaatgatggttctttcattgctggaatgtcctgtttctcctgatgtatttattagccatgagttgactcattctatttttgaggtatgtttcttctgcaggaataagctacataggtaattaagccatttttctaatttgccttttaaatatacacaatgtgcaacaacccttttttaatactgccacttcaattttgccttttgaaaataccaataatatttttctcaacaatttcttagtttactacagattttctttattgttttatattctattttagtagtcattgcttttttcttttatttatataatcatgcttttttcatgattattaaaaaagtagtttctctagtatggatatttttggcaaattttgttgtttattattttttgtatttcttttatttagatctgacaccccaccctcgttcctcttttactttgttcataattttgaagtctcccactgacacttactactttttctttactatataactatttttttcttttttaatttttattttaggtttggggtgcatgtgcaggttcgttgcagaggtaaacttgtgtcatgggggtttgttgtacagattatttcactatccgggtattaagcctagtaccctgtacagttatttttcatgttattttcttgagtataaaaagtggtaaaatgtactccatttatatgaatattccatgtctttcaactttagtagaatttatgcttattaatagctttcttttcctatatcactggcaatggaataaaaccaaacatctgtttctttgttgctatcagcatatttaggaattgacagaatcatttgattgaaaattctctaaatatgatcacagtactttatggattttcatcttttttaacaacataaatatggattacatttgccttataatcatgtgtttgtgatgcaagcagatataccagtacttagatggttctcaggagagactccatttctcagtctaatactggtataggggaaaggaatttaaactgttttcagaaaaaaaggtcatccataccgcgtgtcatgttctttgcatttattctagttttaagtttctttaatatttaacatggagatgttactacttctctcaccaagttataatagaggatgtttagggttgaataaaataatatatgttaaacattttactttatggtttatatactattagtattatgcttattttatatattgccattatcttatcatgaaataacaaaaatgccggggggggggggtctatcgattttgagttatggtttgctaactgcgttgtcctgaatgatttctctgatcatgaaaaagtacacagtgggtggaattgcaaacatcaattcttctggtagtgtacacaggcttctgtaagttaggaaaatccttcgacagttatggccttcaaattccccttcaagacagctgtacaatagaatattgccgtatttcaattttctccccatgaattgttcacattagtttctcaacctaaaatgtcttttggtgtggtcttatttttaatgtgaactggcttagaggtcagagattaattgccaataatattcctgaaaagagtaggaaactacttttaagtaaaacattgcacttaatccaataggtctttattcttcataaaccaaatgtcctttctgaataatatttttcctactcagttagatattttggtatgtcctgtagatacctcaattttaatatggccaaaaatatctgtcatttcctctcttcaaactatttccctctattattcttaattttgattactatagccattatctacatacttttttgaagcttaaaacctaagaactgacatggacaacttccttttttcattcccacaataaactgttcattaaaacttttgaatcgacttccaaatgcttctcaaatccaacctctcctctcgtctccttgccttttgtcaatactttacttcaggcaaactttatctattgtctggcctatagctgaacatcctgacttgtgtccctactctcagttgttccttagtctttcattcctggacatctcgttaaattctctacatggttcccaaagttacctacccattatatcataatatcatttttaaaggtttaaaaggtttttgatgcaatatcattggctattagagaaaagcaaagtaaagctacaatgacatgccactatacacttactagaatgggaaaagtaaaaccatgctgacaatatcaagtgctggtaaatatgtggaacaactggatctctcctgcattggtggtgggaatgtaaatcgatacatttattctgaaaagcagtttggcagtcttttataaagttaaccatatctttatcacatgacatagaaatcacaatctttagtgtttatctcagagaaatggaaacttacattcacgaaaaaccagaacactaaaatgcataggaactttatttgtaatagccctaatctggaaaaactcaattgtcgttcaatgaatgaatgaataaacaaactgtggtacatcattacaacagaatactactcagaaatgaaaaagaataagctattaatagacacaataacttgaatatatattgaggctaagtgggaaaaaagcctatctcaaaaggttacttactgtgtgattctatttatttaaaagcctaaatatgatgaaatgtagtgatggagaacagaccagtggttattaggggttatggtatgaggaagtggagggttgtgactattaaaagataaatttctttatgttgatagaacagtactctatcttgattgtagtgatacactaatctatatatgtcatggaatttatagaactatatactaagggaagaaaagatgactgaaaagtagatgaaatcacagtatgatctgtagtctagttaatagcatacctatatcaattttttggcttggatgaacttcttcgcttacaagtttctttgggaatctctgtactgttttaaaaacttgtttatcttaaaatatttcaaaataaaatcttattcaagggaaaaaaaataaaggcttctactgattcccaagaccaagagagataaaaatcaaatttttaccaagacatataatatgaatccaagttgtttttaaactctctaatcatcactcttcttcattcttgcaagtagttcatatcttagccattgggaaatcacagctatgcacagaatgccttctttcacctctcattgacaaattcccacttatctttcaatacatgggctaaattcttctttgaggatcttctcaaatctcaagtgctgctcctactctgctgctataacacttcatcatacattttttgagaaattatcacaatccattggttttttttctgtttatgcatcagtttctttctttagacaatcaactggacagatggtatagcactgttccaggttcctctcagaggagacagtattagcctaattactttataagctcaatctaaaactaattttacaaccaagcccaaaataaattaatgttttgtattaattgagctgttgcacttagacttggttaatataaatgtttttattttcttccacccacaaggaatgtctatttttcattgttgtttctgatctccatattcttgccatattagcagaacatcagtgtttcaaatatattttttaaagcaagcttcatggatctaataaacactaatatcatcagtgcttttctatggcccagggaaattctatctagagttacaggacatttttgaatagagttagaaatatatacagttctcttggagtccataacattttatttcccaaatattatgtttgtggaatctaatacttgctgttgtgtgctattataggcacaattttaaaaacatttgttttatatataagctcttgggtcatgatctcaggaagtcattttagattatgttggttttgtatgatagaatcactttctaaaagtgataatagtacaacatgacagacagtggtaattgaccatagaaaacaaaagcagaaaaatatatttgtatgaagcaaagcaaattatgtattaagtttgatgccataattgtaataatatgttgagatgcctactaattctaacctcttattcaacctagtttttaaggattttttcctattctttttatcatcagtaagccaaggtctgttcctccttctgtaatagctttttgttttactatagacagcatagagtaaatgcaaaagttttaatcaatacaattaacatgattcacaaaccttccagtgacatctttgccaaatttcataccctatattacgaagttctgcatgaaaagctttgactgtttttctaatcccattgtatatcctccttttatgtagtacaccccagacttattggccttcttcttgttcctccgacatccaggcttgcactggtttgggaactttagctgttatccctcttcagggtgtaatgcctcaagatttcacacacgactttttctggtttttcagatcttagtttaagtgtcactttcccagagaggccttttctgagtatacaacttaaagtaatcttgtcatagtgtgtgtgccaatgctgtcttataacagctcactagggcttacagtatacctctttccaactatgtattgagtgatgtcatattagtatatttaaatcagtcatgttgggaatgttttcatcacagaaaatggcaaaaactcggcttgctttgttccttttagagagctggttattaaacatttgtcagcataccattgcctatattgcctattaatatgtgactctttatattctttatatttcttgcaacctttaatttctcttctgaaaactctattcatatgcatctatttctagtagagtataagtttgataagaaccaattccctgctgtcttgctagtgcctagaatactgatttccacatcatgaatgtacagtaaatattttttgaatgagtaaattactaggctaacctatctgttattcagttatgatgactttattaatatttaacatccattagttgatttttaaaataaagcatctattcttctatgaatgatttccttaagtaacattggatatatatgtatgctctgttattagtctctttcaattagtcagatgcccatttcaagatagctcgttagatttgctttatcctaacatataaacttcactcagaagagagaactttcaaatccttaaatcatctaagaaatctctccaattctttcatgtcaaggttaataattaaacgtttaatatctctttaagctattaagctagcaataaaaatgcaatattttaacccaatttactcgattaaggaacaatcccagatgtgatttaacatgaagaattgcagtgatctgcagttcattaaaatctgaatactaaaaagagaattttaaacatattatgtaaagacgttcgtttacctcttttccataaagaaatattatcttcattttccttaaagcatgttgattatccttaggtactggatatatctaacatgaattattgcctttttccctgcagagctgtgtactggtagttattaaatagcccattatcaactgaaattcagatgcaggttttattctccttttttctgaccatatttttctgctagtgtttatttatttacttattttcattaaaatgaccatgaccttggtgttaaaatcagtaatgtatacagaaaattcatttggaatgcaatagttataattcagttctgaaaatttatgtttatcaaagtataaaatatttttgttatagctcttttaacttttcctaaagtgatgtgtgagcatgatgtaacgtagcagaggcccaaatttcctttaagaatattgcttagacctcatatcatcttctagcctcactataagcaaattgagaactgcaatcatttgatggttttaggacttaacaagaaaagaaaatactaaaaatcagatgtcctacactgagagttttatcttctaaagaattctttcatcttttatgttaaggacctccaaagtatgatgttgttaacgtgaacacatatgtgcacaaatgagagctgcgttacagcgctgagaaactacatgtggatcctgagaccaagtttagctgaaaaagtacatctgtgagcaaacggcattgaattttattattaagcatctgatgaagtggttcaccttttgtttttaggtccacatttgctgaaatgtaactcttatctcatgcactgggagtgatgaacttcactaggaaatcatcgttctttctggtaagtcaccacagcacaaaactgcaaccattgtttagtaacaactagactctgatagatgctgtggagaatttgactagaagtaggaggatcatttactacatggcaaaaaaacaaatcagtctatcttagaaaggttaaaatttacatggataataaagaaaggaaggtagaagaagagtgataaattagtgagaaaagaacagtaggtgtaattatagcaatatgcttaaatgaaagagaaaaatatggcagaagcatttattgatttgagattgtaatttttttaaataaaaaagcttagtctggattccaacttgtatataaaattaggagcaaaggtatgattaatatgttcatggaatataattatcaagaaaccacagacatttgtgtatggaggacacagaaaggtgagaacttgctaacaggaatcccattaaagaagcttcagaatttgaagatcagcaaagagaaggaagagatgagaatgaaaggctttatgaaggaatgaaatgacagtcattgcatttattgatgtatctgtatttaaacataagtatatttatttatatttgaacataacagttttctagcaaaattaataaggattatgctacagacatactcagttacgatcttagagggattctgagaactctttgataggttatttacttatagtttgtcagtagtttctaaacatttttggatggacatctctataagtaataatatttgagcaagtaaacttcagtactatatttgtttatatgtacacaatttttctaatatataatttaaaaatacctactaaaattgatgagataagatgaatgtaaacagaatttttaataaattatttctaccacagcagatcatttttgtatgcatcccaatctggagacttcacagtttgatttggcattactattgatttgaaatagagttttgtttatttgtttcattgttacaaagaataggaaacacaacatagaggctcccctcctagaatcaaactaactttagcatattatcaacaaatgcttgcctctgaaaaaatactattcacttcttgtattaatgagactttatccaatttaatttcatatattggatgaggttaggcattcattagaacaagtcatgacaggctagcatttgtatttattaatagtatggtagatattgatctttttttcttctgaacaacaggcattctattttctaactattctttcctcgtttcatgtgattttgatgaggctataaatcacaggaccctgctctttcagcttagtctaattttggcacaaagtatgcatttaataactgataacaattattactactattgtaattattactattattgtagttataggtactaattgggatttgttgagagtcccatatttgctctatggaataaaccaaaagttgatcaactctttctgtaaagggccagatagtctatgttttgggctttgaggacattatgttctctgccataaccacttaactctgccattgtaacataaaagtaaccagacagtacatcaaaaaatgaatgtggttttgttccaataaaactttagctgtgaatatggaggtgggtttgatgtaatttgagggccatagtttgccaaaccccagaaaaaagcatacaaaatttactgaatgccaatctgtacaaatgcatagctagtgtgttaatacataaatatgcatacagtcattcattatataataatttagttcaataatggtctgcatataccatggtggttccataaggttgtaatatcatattattactgtacattttttattttgacatgtttatatacataaatacttaccgttgtgttacaattgcctgcagtatttggaacaatcacaagctatacaggcttaaaagcgaagagcaataggctctataccacatagcctaggtgtgtagtaggctatatcatgcaggtatacatagagcataagtacattctatgatgttcacacaacaaatcacctaaggactcatttctcagaacatttccctgtcattaagtgatgcatgactacacacgtacctgaaactataaataactttgaagcataaatagttggttgctttctggtatttaaaatcaagcctactttttaggctaagtgatagaagaataagaaaatgctgattcctttcaatgtttcttttgctttcattatgaactgaatgcttgtatgcccccaacatttacatgttaaagcctgattcccaatgtgatggcatttggaggtagatcctttacaggtaattaggtcatgagagtggagcactcattagtggtattagtgcccttataagaagacacaggatagagtgtgcttcctctttatctttttccaccatgtgaggaagccgtggaagaaggtgatcatcagaacctaaccatgctgacaccctgctttcagaatttcagcctccagaactgtaagaaatacatttctgttgtttaagccacccagtaattcgttatagcagcctgaaccaactaagtcagctttcattatttgtttctttatgatttgctgatcttgttttgtgcttcacaaagatccacataaaacgtcgatccccccagtagttcacttgcagttggtcaatttcctgcagcagagctaatcaactcattgcagactctccttgcctttctattctagctgatctaagtttgatctgtaaagtatagtttctatgtcaactttaattttgctatgcactttttccatgtctttaaaactacataaacacatgtaatatttaaacactgtggtctattctaatctatgaaaagcctattattctgttccatttttcaaaatacatttctcaattacaatgatgctataagttttataaactcccttttattaggcaaggaaaaaatgcccctcttctagatagagggcctccaagttaattcatcagcagtaaacattttttttcctatggttaaattgatgtattcactgctccgtcctttcttacttctcaacattaaccctccaacaacctggattttcctgtggtctctgaagaattttctgctaaataatgtatccatcactacttttgacttataatttctattttaataaaaaaagattgattttttaaaattaaaatattttattcttaataaatattaaaagactgttactgttaaaatacattgattctatatatattttttctctatccttcctttgaacgacgctcaaggcatttcttccattatgcctacagacctgtgttataacacattctttgccaatccttgaaataaatgcttagcaaggtaatcttttagttgtatcaggaggaaaagctatttgctttctgtcatcacagaccaatcacaggtcctgtttcaacttcatttattaatattgagtcaggtatgctgctcagattcctttgtatatgctaaactgtctccacaaattggtgtttaatgtctacaagaaaaaaaaaagagtggctatatttgtagcaaaaggtaaactcattgattttcatctccagaagcaatacaaggatgatttatttccttgagagataatttcttatatgtatagtaatcaaggatagcaacacaaatgaaaatgtaattatgagtactgcataccatattggtttttttcttctatttcttctgtttttgttaattgtcaaagccaagagtatgtcaagctgagaaaatgtcattaatgaggatatagattaaatggtctgtgggtaattaatgatgactgcaatgtctttctcactttctgcataaaagatggggtttattgcttctctctttgaacctgggttagctctgtgactgcttcatcagtaaaatgtggtagaaatgacttggtgacagctgaaagtttacattttaagcagagtctgctcccatttcctattgcttggagtgcttgctctggggaaaactagatgccctgtaagatgtgtgaatatttggaactcgacacgctatgaggactccaagccggccatgttgcaacatcatttaaacactatgcatattgaattcagtaggttcttcacacagatgctatctttaaaaaaaaaacaaatgtagtttaacaatttatttatttgtttttgtcaattcttacagcaaacatttgtagaatatagttaaggatacagagataaaagataacatttttatccacaaggaatgcttattgtattctgtgagacagaaaagtaaacacacaaaatttaaaaagtattataggtaataaggcagaaaaaggtacaatgtacaagtttggatgctaagaaagaaatactacttctatccggaggcatggtatctagtatgctctttgtgtataataacaatatattattatatgttttatatgcatttttattaataatggtaatggcaactctccattattgagcacaaatcatgtgccaagcattatgcaagtgagctactattctgcttctacctgagaaaggagcaagaaattagaaataacatgtttctaaaaatttccaatccaaattgatcatctcaaaatagtatggcacttaggtcaatcaatttcttgggaaaagaagctaactagattataaaatgggatccctcctcaaaaggcagctcattcatgataactctctaaatggttgtatgaaaagataaaaataattaagtttcatcctggaccttttgatgctaacattaaaaggacagcactgtcttctcacaaaaatcccttatttttcttcttaccaatagaaatccatgatgagtgagcttgtctcattgtggcaattcctataataacagataacaactagtaacaaatgtctctgagtcaaatctctcttctgaccagccacactgaatgagataatttgtcatttcaatttaagtgtttgtgtgatgatgagaatactgaaaatgtgacttttaaagcacttgatgatactttgaattctttagtttttgtagttttggtccaaatttgcttgctttatttcctcataggtaatgaaaatataaatccttagcctaacacttttgcaaattatttcaaaatgagaataaatgaagtttaaattcattgtgtcttactcaaattgtttttactcatatggttgagtttcaaattcaccagctgcacaacctcatgccagtcatttgtttccctcacatatgcctgtgaagatcaaaggttatagttcttgcttgtggttttcaaaatcagttttgctgagaaaactgatctctaaatcaatgcttagtcagaagccaaatacgtaaagcacataacctcagggttacttgaaggatctctaatcaatggagataggatatgatgaaattggacacgaatgtgttagatagcatattagttgtggatgttacacaaagaagcactctcctcaaataagtttgagacactcagtgataaggaagttacacagtttctttattgcagtacttctccaagacctagttatgctgatgtgaattgttattctgtggtgaagggtagtatttctcaaagttaggcaacaaatcattgaactttaagaaagacagaagtgtattttatgtactattttatcctcaatgcttcccataatatctgacacataagtgatatcaataaacaacatttgactgaatttaaataatccatgagatttggtttctgtgccactcactactgagtagctttttgttttgaagaacgtagtcttttctctctgttattatttttgtaatgtgagagatgtctacaaacacaagaaccaactgagcacaaaacaaataaacaaaagctctgaatctataactaattgaaccactgaaatttttcatctaaactttccttacattctgacatccagaaaagaatttctgctcaaatgggcaagtcataaagacaaatacttttaactgtcttggtgtttcaccccatttgttttattatctcttacttctttttatgtaagttatatttagtagacatttgtccactattaatggacttctttctagaggtggcattatgttgaatttaattttttaaggtcattgcaagtaaatgaaaaatttctgtctattatggtcattactattgaaaatagatgtgggagaatattctgtttatcattactgggaagatatgtaccaggtactgttctaaatttagtacatttttcaaaatatctaactttatttaattttcctaaaattgcatgagatggatattaccgtcttcattttctcaacgagaaagaacttgaggatctgaaacattgaggaatttttctaagaacaaatagctgtgaaattacagagttgaggtgaggactcaattttaccctgactccaaatcatatactcttaaataataaataatagaaatttgaaatacaaaaatcagtttctctctccttctggtttcctcattttattctgagacatcaagggaaagaagaaaatatcttctatgttaaaacccctcacctcaacgtgaatttgtacactattccagttttattcccaaagtgattgatgagttcaaacagacagaggtgagggattggaatattaatatcaaagatctcaaacgattttctctctcctatgacagtattgaatgagcttaaactaatgttagcatcaagatcttcaaaacatcattcatcgtggggaaaagggaatcaatactaacatcaggatcttccctcttacttaaagctttaattcacttctatgttccacttatataaccccaaacagccaatacatttcattttataatattgcctatgaattttacatatttattttgtgttatttcattagtcactgcatgcatgcctctgtcccttcaacaaatgtttattgaggacctattacatgtcagcactgttgtaggctctgggatgcatcagagaacaaaacaaacaacaatccctgatgtaacggagcttgcattttaatgaggaaaatagactataaataaaataaataagttaaatcaatagcatatgagaatattataagtggggggaaatcactcagagaaggcagagaaggagttttgggaagtaggggtgaattttaaattgagcattcagaaaaagactcactgaaaagatgaaatttgagcaaatgcatgaaagagatgcagaaatgagccagctggatatctgaaggaaaagcatgctaggcagagggaacagcaaggtggcacatatgctaaactatacggtgaggaacagagtactagagagatgaattcacagagcaaataggggagcagggtgtgtgtgttcaaaactgcagaccaggggttagtaaacttgccttctaaggggccagattataaacaggttcagctttgcaggccacattatctctgtcacaactactcaactttggcattataatacaaaagccatcattgtatgtaaaccaatacatgtgactgttctaatccaacttgattttaaaaagcaagcagtggtcaaatttgctacaatttcccattgcagaccattgagaaaattttggcttttgctttaattgagatgaagtgtagggtagttttaaaaaaactgtggcatattctttagatttcttcccattgagaggtgtctctacatcttgccttcattttggctggacttatgacttcttctacacatgtactatggtagaaatgatgctatgcgacctctaagcctagttaataaaaaagcatacaacttccactgttttctttgtatcctccctctagagaaaaccaactaccatgtaagtatatggctaccttgaggccactgaattggagaaaccacattgaaaaatctcacaagtaggacaggagatgccagataaatcccagctgttccagccttcacgtagttgtgtcatgcaaacctgtgattgtggaaggcataaagatgacttcagcctcgacctccatctgactacaatcacatgacagatcccaaaccaacacaacccagctgagtctagttggttcccaggaccttgagcggagtgatacatatttttttaagccagtctgttttggaattgtgtcttacacatacccaggtaactgaaatcagcactctttaaagtattttgagaaaaggaattatgcagcattaatcttgtgttttaacaggatttctctggctttgtgggtggcaaaaaggaatcagggagactattttaataatccagacaaaagagtttagtgggttggaccagaatcatagcagggaggaccaagaaaaagggtaggattttgtttaactgtattttgaaggtacaggtaactgctttacctgataaattacatgtagaatacaagacaaagggttgaatgaaggtgtctccaagagtttttagcatgtggcagaatgtagctgtcatttactgagttggaagaatatgagagatgctgatttgaaggtgaaaaatcaggacctgagttttggacttgttattttctacatggttattcaacatccaaatggagaaagcaaaggggcaaatatgtatgagtctagcttttctagcagaggtcttatctggagatatatgtggatgctgccagcctctagaaaatactgagttactaaagcacaaacggggaagagaaataccaagagcttgaggcacttacattttaagagggcagggagataaggtaggattatcaagagtgttcaagagaaaagggccagagaggtaggagaaaagttaagagaaagtgatgtccaaggaagccaagtggaaacagtactgatgcatgaaccaaggcaggcatttattatgaaactgagcatccagaaaacagggtgaatatttaatacctgttttgtcttcatttatgaaatcatgacaaacagcgttcatatcttgagtccattctatatgcaagtacaagtaaaaccttagcaagtattctcaattacaagtgcaattttagatattgatgaaggatgggcaagaatttggaacaatttgctagggatgatataaaattgtaataaataaaaagtgttactttttggctgtgtccccacccaaacctcctcttgaattgtaataccggtaatcctcacgtgtggttggaggaatctgatgggagacgattggatcgtagaggtggtttcccctatgctgttctcgtgatagtgagtgaattgtcatgagatctgatggctttataaggcagttttccctgcttttgctcatgttccctcacctgccaccatgtaagatgtgcttgcttctccttctgccatgattgtaagtttcctgaggcctccccagccatgtggaactgtgagtcaattaaacctcttttctttgtaaattatccagtcttgggtagtatcgtttagcagtgtgagaatggactaaaacaagaaggaagattgagacaacatgctttggcctcttctctgtttgttgaacatcctggggaatccaccaccataatatctcttctgttttaactgaagacttttgtgcaggacactgaattcgcaccaatctttatgttcatattgacaactcagtgattaatagggataccctaatttgtttcatatgctacatggtcacaaatttagatatgtaagctgcagaaatgaattggttcaacctttctgtaaactggggctttatacaaggaacaattaaaatttctttagttggcttttctctgcactatttccccatttgtctatctaaatctaaacacagatgccatagtcctgttattctacccttaactgtggtgatgcaaaatataatgcaaaagctcaaaaatgatgcacaataatagacatgcgcaaccagctttgtaaacaaaagtttgcagtgaggtccccaaagactggaaactaaatgtttccttttcaaatgaacagctaatatgtctcacggttagaatgtaaaacttgcttcattactcatttaacgacctggggaactaaaaccatcctttcctcttccaatgtttgaaagataattttaaattttaaatttcatgtttttctcattattaaggattgataatggacccaatgcatgggaaaactaatctaacaaaaaatacattggaggtgtcaaggcagtgtgtattagtggatgacacttaaatgagctgctaacagggctcagaaagaacctgacaggcaccatgattgatctattattggcctaggtgacattattggatttcagaaatttgaattaaaaatttcacctaaagaaaaagaataagtttgaattcaggcagataatttagtatagtcattattttaaaaaacttgctgaagtgaggcagtgtctacacagtcaagtaggctttggtaaatattttaaatattgtgatttttacctgcaatatatttgtatactgcaatgcctttgtacaccacagttatattttaaatataccattttaagttattttcgtttgtgtgaataatgttgaatatctgatttcgtagttaacctggccagaggcttttttttaattgaacttttcaaaaaatcatcttctggttttgttgatttctctattgatttcccatttttatttcatttatttctactctaattttaatttattttcctatgcttactttggatttaatttgcttttgttctagttttctaaggtgattaatttttttaattttaataagtttttgggaaacaggtggtgtttggctacatgaataaattctttattggcgatttctgagattttggtgaacccatcacccaagcagcgtacactgtacccaatatctatgtagtattttatccctcaacctcctcgcaccctttcccccaaaatccccaaagtctgttatatcattcttatgcctttgcatcatcatagcttagctcccacttatgagtgagaacatatgatgtttggttttccattcctgagttgcttcacttagaataacggtatccaattccaaggttgctcaaatgtcattattttgttcctttgtatggctgagtagtatttcattatatatatatatatattttatatatatacacacatatatcgatatcacattttctttatccactgttgattgatggcatttgggctggttccatatgtttgcaattgtgaattgtgctgctataaacatgtgtgtacaagtatcttttttgaataatgacttatttacctatgggtagatacccaggagtaggattgctgaatcaaatgatagatctactttcaattctttaaggaatctccacacagtttcccatagtggttgtactagtttacatccccactaacagtgtaaaagtgttcccttttcatcagatccatgccaatatctatttttttttattttttgattatgacattcttgcagaagtgaggtggtatcgcattgtgattctgatttgcatttccctgataatcggtgatgttgagcatttttcatgtgtttgttgaccatttgtatatcttcttttgagaattatctattcatgtccttagcccactttttgatgcaatcgtttgttttttttcttgctgatttgcttgagttccttgtagattctgaatattagtcctttgactgatgcacaggttgtgaatattttctcccactctgtgggttgcctgtttactctgctgatcatttcttctgctgtgcagaagctttttagtttaatcaattcccatctattcatctttgtttttgttgtgtttggttttgggttcctggtcatgaagtgttttcttaagtcaatgtctagaagggtttttccaatgttatcttctagaatttttatggtttcaagtcttagatttaaatctttgatccatcttaatttgatttttttataaggtgagaggtgaggattcagtttcattcttctacatgtggcttgccaattatcctggcaaccatttgttgaatagggttcctttccctattttatgtttttgtttgctttgtcaaagatcagttggctgtaagtatttgggtttatttctgggttctctattctgttccattggtctatatgcctgtttttataccagtaccatgccgttttggtgactatggcctgatagtatagtttgaaattaggtaatgtaatgtctccagatttgttctttttccttagtcttgctttggccctgtgggcttttttttggttccatgtgaattttaggattgttttttctaattctgtgaagaatgatggtggtattttgatgggaattgcgttaaatttgtggattgcttttggcattatggtcattttcacaatattgattctacccatccatgagcatggtatgtatttccatttgtttgtgttgtctatgatttctgtcaacagtgttttgcagttttccttatagaggtctatcaccttcttggttaagtatattactaaatttttttgttgttatatttttgtggcattttgcagctactgttaaaggggttgagttcttgatttgattctcagcttggttgctgttggtgtatttcagcgctactgattcgcgtacattaattttgtatcctgaaactttactgaattcatttaccagttttagaagcattttggatgagtctttaaggttttctaggtataagatcatatcatcagcaaacaagaacactttgacttcctttttactgatttggatgccctttatttttcttttgtctgattgctctggctaggacttccagtagtatgttgaatacaagtggtgaaagtgggcatctttgtcctattccagttctcacggggaatgctttcaacttttccccattaagtataatgttggctgtgagtttgttatagataaggtgattaattttaaatatttcttttctaataaatgtattcaatgccataaatttctctctaagcactgctttcgacacatcccacaaactttgtaagttgtattttcattttcatttagttcaaaatacttattttgttgttgttgagattttttctttaatccatgtgttctttaatagtgtgttctttaatcataagacagtcagtagatgtcagttatatccagttaattgacggtgctgtgtttactcttttttctgtctgcttgatatgtccatttttgatagaggggtgttgaagttaccaactatgatagtggactcatgtttttctccttgcagttctattagatgttgcctcatgtttttgatgctccattgttaggcatctatacattaaggattgtcatgtctttataaggaactgacccctttatcattatgtaatacccatctttagccctgataactttctttgctctgaagtctagtctgtttaaaattaatatagctgttcccattttaaaaattagcatcagcatagtatatctttcagtatgtgctcctatagttaatgcatgtttcttgtaggcaacatacaattgggaaggtttttttaaatccatttttacaatctttgccttttaactgatatatttagaacattgatgtttaaagtaactaatgatttagttgaattaatacctatcatatttgttagttttatatttgttaccctttttctttgttcttagtttgtcttccactattttactgcctttcgtggctttaattgagcattttgtatgattccattttctctcccttattattagcatatcagttatgcttcttttttacatttctcagtggttgcactagagtttccaagatacatttataactaattcaaatccatgttcaaacaacattataccacttcacaggtagtgtgtgagtaccttaaaataataaaataatcataattcttccctcgtcacttttatcattgctatcattcactaatatataagcatatataagtgcttatatataagcactcataaaataacataatagtagcatcaatatattttattacataatcacatgtgtaataaaatgtatatatgtaatatatatgaaatttatatatatattatatataaaagcatatgtaataaaatgcattgttgctactattttgagcacacttctatttgtagatcaattaagaataagaaaaatattttttcttcgtgaccccaggtgtcatggataaaagatctatagatataattttcaagtcagtgcaagggtattttttctgacaccgaagtgatattaaagtggactgaattctcttgggaagtatttaactcctaattctggagctattccagtgcttgataaaccactcagtgaagatactctcaaatgagttcttagtatttttgtgttaaacagaaaattttccagtgttaggataattggcagggatggaaggactcaaaattgcactaattgtattattcataaagaataatggagtcaccaccaaagaataacacagtgtctgaaaggcatccacggatatcactgtcttcatttgttgagtcttcatcatcaggttactgttttaatagagctatttacttccttgggtacactctcagttgttcactcagatatgttatcataagttcagataaataaaatattttcagaatcatcttgaaatttcactatacctattatttgcaacaaatgttattccagtttccctttgactcttttagcttaatgttctgtgtaacagccattgctgttaatatacgtatttggggcaaaaaatacaatatcctttgtgatatcccttggattgtaatatctgacctttgaccccacatgttttaattatgcaactaattatcatgtaataaaggaaatacaacttcaagatggtagctttgtattttatatttaaaatcttagaaagttttattattgataaataaaaggattcaaaataatcctgaagtataatgatgttaaacatatagtttagaactagattaacaaaataataccatttgcataggtagggtgtctgatatgcttctaaattaatttgatttgtatattcttgaaaactcccacaagttatttgcatgtactaaatagatgttgctttttattctgaaagaatgagaatgaagataaaacataggttcatagattggtcaacatgcagaaaaaccaatattgattatttttacagttcattacatcattaacatattgggatttcccttttactacagacagtaatatatttcactatgcatgtttattgaaatacgttttaaatagatttgcataacaaagtatatattagttcaagcagatgtttagggtcataaccgtcaagaaatttgagctgcccaggcgtgtggcaaaatcagggttactaatgattgttttattgtttctgcatttcagtcatagagtctggcagattgcaagtgtactgttactctgtaggaggtataaaatgttcatgatgttatcttgggcgaggcctccagcctggaagatcagcataactctgagttgctaatctggccagttcagtctttgtttttatagagaaaatcaaagatatatcaattgatgctagttgcaaattatagaaatgttgtgattagtatttttgaaagtcttatattaacaacacttcattagttgaaaattcttctcctaggctccagttactatcttcccagcttaaatccagaaaacaacagcaatgtctttgccagctacctcacatttggagaattgaacactgtagctcagcttgaggaaagatgatagcattggaactgatttcactttctgagcctttttttgagggtatttactaataatacttctgaactgtaaaatctgtgggttagcatccccctctgatgcaagaaacctggagtttactggctagctagcaaatgcaaaattagacaattttgctgggagctaaatatacacggttaagtgtgtttgactattatatggctgcagaaagttccacatgccaatttatttgcttatggtgttttggaaaatggaatcctttagagaaagagaaagagaacacaccaactttcaactccattgattttaattaagctaactgtagattggcaagcactgcaaaattcacaaacctgatgagacaaaagagattacacaataggtacaggaactaatggctagtccttaattatctgaaactgacaagacaatgacctgtcaaattaatggaaattatcttccataaagccttggtggaatggcagcataatattgaacttcagaaggaaaagaagcctggaccaaaaagaagttccttgcccttaaaaatgagcataccataatagacacagacatgggaagatgctcatgatgtattaagtagaaaaaaaaaatagaaaataatatagtcagcctgttcccgttttggtaaaattgaaatacaccaaaccacttttacctgttctaccaacataggatgtgtacctggtcactcctgtttcgttttattgtatatatatgtattttttttcaattaatattggaaaaccccattttctcttctgggaaaaaaaatctaatactgtctctaggtccttctgccaaacccagtgagacagatcccagatgccaatgccattgcttatcaatatcacatggtatcactgtcagatgcacatcatgaaaaacttcatgcctgtctgctgctactgggatacccttgctagtagaagcctgtgccagagtggtgctcatgaggtatcaaggatatagcccattttacatcatactcccatgttccatccttattccactaaacaatcatggagctagtaaggctgtgtttggatgagttactgcaagctaattttagtaggccaaataatgcatacagtaaactagagaatatttgcttgaaaatattatggtgacttgtccttattttagactcacctcgtaagtagtaactaaaacagtaaatgaatgaatgcaagctgtctggaccagcttggtaataaatatcctgaagttcatctttccatttttaaaaagtcacccaacttatgtttgataaatataaacaaacttttttatgtcatcattttaaatgctttaggaaatggtttcatttccttttgttttgtccgatgttcatatctttcatgctttgcttatcttttggaagtgtctgtccaactagagctcttccaaagagatatttggcaaggacatcttctgctcccaggtataaaagggagtcaaacaccattattatttttatccttcaggaaaaaccttctgtgaaaatcctgattgcatttccttttataagattctgtctcatatttattaactgaaaggttgggtcaaatcagccacttgtactctctgtagtttatcagcagaaggattctttgaaagattaaattgcacagggctgacttctaaagtgcagtgaaaaaaataaaaaagccacttggtaaaaatgctaaaactgttattttcttgggaaatgttgtagaattttagcaaattaacatgttacatttaaacccatttgtacttgagactggattgtttatagatgcttgaaagaaccattatttgtgtgtacagataagcaaattgaaaaacataattactcataaccgtgtttcatgttttccagaatcttaaagaagtcaaaaatatcagtgaaatcaagcatggagaaatattgcattattaatattatactgaaaagtaaataagatttttgaatttctttataaatcatttttagttatcataatccttcaagcatcaattcactgtgttttaaaatgcacatttattatctctgtatgtgatttttcacatctttcatttttttctctatatttatgtttggggaagaacgtggaatatagaatgcagacatgatgtctctgaaatacatgtctcctctcccaaagacatagtcacattttatagttaaattttggtttgaaagttctaatttctcttccattaacctttctgattccaaatgctaccagtctctgtggccaagagaatgatacaccatctttctccatccccaacaacagaaagctcagtttcatcttccattttccccagcttttccacctcataccactcagaaagtcctggattttattttcttttgagtttcttgaataggtttaccctttctccatttctgattcctgagtcctttcattagtctcttattattattattattattattatactttaagttctagggtacatgtgcacaacgtgcaggtttgttacatatgtataaatgtaccatgttggtgtgctgcacccattaactcgtcatttatattagatatttctcctaatgctctccctcccccctcctccgaccccactacagaccccagtgtgtgatgttccccttcctgtgtccaagtgttctcattgttcaattcccacctatgagtgagaacatgcagtgtttcgttttttgttcttgcaatagtttgctgagaatgatggtttccagcttcatccatgtccctacaaaggacatgaactcatccttttttatggctgcatagtattcaatggtgtatatgtgccacattttcttaatccagtctatcattgatggacatttgggttggttccaagtctttgctattgtgaataaacatacgtgtgcatgtgcctttatagcagtatgatttataatcctttgggtatatacccagtaaagggatggctgggtcaaatggtatttctagttctagatccttgaggaatcgccacactgtcttccacaatggttgaactagtttacagtcccaccaacagtgtaaaagtgttcctatttctccacatcctctctagcacctcttgtttcctgactttttaatgatcgccattctacctggtgtgagatggtatcttattgtggttttgatttgcatttctctgatggccagtgatgatgagcattttttcatatgtctgttggctgcataaatgtcctcttttgagaagtgcctgttcatatccttcacccacttttttatggggttgtttgtttttttcttgtaaatttgtttgagttctttgtagattctggatattagccctttgtcagatgagtagattgcaaaaatgttctcccattctgtaggttgcctgttcgctctgatggtagtttcttttgctttgcagaagctctttagtttaattagatcccatttgtcaattttggcttttgttgccattgcttttggtgttttaggcatgaagtccttgcccattcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcaaatggttgtagatgtgtggtattatttctgagggctctgttctgttccattggtctatatctctgttttggtaccagtaccatgctgttttggttactgttgccttgtagtatagtttgaagtcaggtagcgtgatgcctccagctttgttctttcggcttaggattgacttggcaatgtgggctctttttttggttccatatgaactttaaagtagttttttccaattctgtgaagaaagtcattggtagcttgaaggggatggcattgaacctacaaattaccttgggcagtatggccattttcatgatactgattcttcctatccatgagcatggaatgttcttccatttgtttgtggcttcttttatttcactgagcagtggtttgtagttctccttgaagaggtccttcacatcccttgtaagttggattcctaggtattttattctctttgaagcaattgtgaatgggagttcactcatgctttggctctcagtttgtctgttattggtgtataaaaatacttgtgatttttgcacattgattttgtatcctgagactttcctgaagttgcttatcagcttaaggagattttgggctgagacaatgggattttctaaatatacaatcatgtcatctgcaaacagggacaatttgacttcctcttttcctaattgaatacactttatgtctttctcctgcctggttgccctggccagaacttccaacactatgtagaataggagtggtgagagagggcatccctgtcttgtgccagttttcaccggaattgcttccagtttttgcccattcagtatgatattggctgtgggtttgtcataaatagctcttactattttgagttacgtcccatcaatacctaatttattgagagtttttagcatgaagcgttgttgaattttgtcaaaggccttttctgcatctattgagataatcatgtggtttttgtctttggttctatttatatgctggattatgtttattgatttgcatgtgttgaaccagccttgcatcccagggatgaagcacacttgatcatggtggataagctttttgatgtgctgctggatttggttggccagtattttattgaggatttttgcatcgatgttcatcagggatattggtctaaaattctctttttttgttgtgtctctgccaggctttggtatcaggatgatgctggcctcataaaatgagtccgggaggattccctctccttctgttgattggaatagtttcagaaggaatggtaccagctcctccttgtacctctggtagaattcagctgtgaatctgtctggtcctggactttttttggttggtaggctattaattattgccccaatttcagagcctgttataggtctattcagggattcaacttcttcctggtttagtcttgggagggtgtatgtttccaggaatttatccatttcttctagattttctagtttatttgcatagaggtgtttatagtattctctgatggtagtttgtatttctgcaggatcggtggtgatgtcccctttatcattttttattgcgtctatttgattcttctctcttttcttctttattagtcttgctagtggtctatcaattttgttgatcttttcaaaaaaccagctcctggattcattcatttttttggagggttttttgtgtctctatctccttccgttctgctcttagttatttcttgccttctgctagcttttgaatgtgtttactcttgcttctctagttcttttaactgtgatgttagggtgtcaattttagatctttcctgctttctcttgtgggcatttagtgctatacatttccccctacacactgctttaaatatgtcccagagattctggtatgttgtgtctttgttctcattggtttcaaagaacatctttatttctgccttcattttgttaggtacccagtagtcattcaggagcaggttgttcagtttccatgtagttgagcggtttggagtgagattcttaatcctgagttctagtttgattgcactgtggtctgagagacagtttgttataatttctgttcttttacatttgctgaggagtgctttacttccaactatgtggtcaattatggaataagtgcgatgtggtgccgagaagaatgtatattctgttgatttgggtggagagttctgtagatgtctgttaggtctgcttggctcagagctgagttcaattcctggatgtccttgttgactttctgtctcgttagtctattaacactcacaccgtctcccttacccccccctactccaagcatagatactattatccaacttttaagtatgaaaaaactgaaggctgctcagggcttaaaggtttaaattaaggctatgatttggatccagatctgcctctctctaaagcatgagcttttcaacattacaataggctgtctcacttttcactgatatcagagtaaccttttttaaaccatggtgctgaacatattccatttccctgcataagtggattgcaactggtgtaggtttaagtacagatttcttagcaggacatcaaagtttttaattacctgactctcacctgcatttctggcctgttatatttgcaatcactttctcaatgacttcttatattgcaggttaatcaggaatatataatcagcctgcctagaacatgactccatgtcttgcctatgttagactctcagcctggaaacccttctacttaaaacttgtcttcttatctcacacccttagctaggaaaagttttctaacttctaggtagagctggttcctccgtcttccaggcatcttcacaccttgtactaggcaatgagctcttcaacaagagggcccacttgttttctactttcttattctgcagaatctattgtagagccttgctcatactgggactaaaaatacatttaaaaaataaaattaagcacacttattttccataggaatttttgagtcattggttccctgaatagccctactccccttttccattttgaagaagtacgtatagttttccaaaacgttcttgtttgaccagtgcgatcagttcatttagtcaaagcgtttgcactgttcctaacttttctaccttaagaagcatacttttgctcaagcagagcgtttagtgcacgtctcctttaacagattcctgctgagagctaacagctggattattgaatcttctccttcaaaaccactctttgacttattacaagattatttttctcagttacatttgattctttataggtaccgttttctgcccctggccttgtttaaaattgaattgtgatggctcttcccctgacttgtcttttaaagctattatcatttacttcattttttttttaggcctttactggaaaatttctggctgtaacactttcttataatttctatttctattccaggtttctgcttaagcacagtgttgcattaataagggtcaggcaaagtttcaacagcatttaatcttacactttaaatttttgttcacattttatggtcttgacacatttactgtaataaagggaaatcattaattcactaagaaacgtgtaaaaactatagttttgcttttgattaatttccacattcatcattactttgctactaatttaccatgcattgaagagactgagggtgcaaaatatgattttttttctttgtttaaaaagaactgtcttagaaaccaaatgaggctaaaaatgtacctgtgttttggctgtcaaaggggagaagattacttcttcttgaacgtgttttctgtctcatcctcatgtttcctttatttataccaaatacaccataccgttctctactttttttttttgaagtaaaagaaagctatagccgtagccactgtcatattaactctgaaaataggttttttcctttatgaagaggaaagaaatcttaatttacttttggcttatggaaggaaatcatctaaaattttataatgccagctacatcttgaacatttttgaatactgttgttatgaaacaaaatcatacttgagcctagaggtcaaatatatcaccaatattggcagcaggcaattgaataacgattttttgtttttgttttgcacttggataattgatactaaagtggtagtgactactaaaattaatgaaaaggaagctatagtttttacactataactaggccaaattgggaaggtatcaaaattatagttataaaatgagactgaaagtttaaaacagatcactacctatgacgcacacaattgcaagccctttttcgtagatcagtcaatgaagtctttgcaaaaacccaaagagggttattttggattttaggggaggagaaaactgagactcataaagttaaataaactctcctcctttattgtattgttttgttaaatatagatttttattcgtatttttaacaacacaaatatttgtagaaaaatttagagaatgcagaataagcaagagaaaaataaacacaatgtattgctatccccccagttttcttaactgtgtattacgcatttttgtgtagcctgcttttttgctttaaaatgtcatgaccttttccaaccataagtatgttatttttcatatgtcagttttaatggctataatattctcctcagtgtttttgagggtctttgagagcactcagtaagtagcacctgtcttttctacccaattcagttgaaaaatagacagcaagtggagaaccagaatatcaccctattcctaattaaggcacaattggcaggcacagcttacaatgagagaaaaaattggcttgctcactgcatcccttggaagtttgttgagctgtgagaagaacccacttcagggaaagcttaaagccagggagcaggaaatccctgcccttcactgtccctggctagaggaaggaggaaaagaagcaacttctccaagcagagaaactttgatcatgtctacccaatacctgtaacacaccaaccactgtaaagctggtggtcctctgctctggggatgaggaagtggtggaaaaggaagccaggcagactgcggaggatgccacaaaacaaaggtgaggaaggaggcattcccctgtgatatatgaagttcatattactcatttaatcaatcccctattgttgtacacttaggttgtttcaaaacaacaatgaaattaaatgcatttgtaattaattattgtgtacattatagaaattttctttaaatgaaactctataagtaaaattcctgggacaatgtttttaacatgtttaaaggttttaatgcattttaccacattttactcaggaaagttttgtcaatttacattaccactcagtaatgtgtaacctcatttatttttaataagtgtatttgaacccaggaaagttggctctggagcccaaattattaatcttaacaaaatcctgctagttactaaataaaaaaaaaactgtaaaattcatgaaatttctctgactccataaactttcaatggataatttctatatctgtccatactgcctgggagtggagaattataatggtcatgaaagtggcctttggccttggactcctcctggctttgaattctgaatttgcccttaactagagctgtggcaagttatcatagatgttcaagcaactctgctcttcacagtgctaataaagacatgcgcaagactgggtaattcataaagaaagaggtttaattaactaactgtttggcatgactggggaggcctcaggaaacttacaatcatggcacaaggtaaaggaagcacatccttattcacatggcagcagcaaggagaagtgccgagcaaaaggggaaaaagcaccactcactatcaggagaacaggacatgggaaacctcccccctgattcaattatctcccactgggttcctcccatgacatgtgtggattatgggaactacaattcaacatgagatttgggtggggacacagccaactcatatcagcatccaccacatcaaacccactaagtgagctacatttttgctgcatggaatgaaaatgtccacacagcacagagaagaatatgtgcttcatagagtaatgatagtcaggttaacacaagatgcttctgtgagaggctgatggtcagccctgagatcagtaaccagaagccgtggcttccagaaggctgcctggatctggttagtgaggatttcagtagtgaagtgaccagcaataggagtagctccagtggcagcagcgaacttcagcacagcccactggccaggattcctggacgacctgacattgacatcagcagggttttcaagggcaacaatggcataagctgtcagcagaagcttctcccaggtcctcttcagatttaggatgtagatgccatcagttttccttttatagatatactgttccatttggaagggttggtgccacctagcaggttccagctactaggaactagagggcatcctcctccttcatttgcaggacatcaaggactcccgacattgtgaaagtttccatttaagttaccatgggaacccagagcaacacatgtggactcctgtctggatagtgcagaaacctaagcctgctttattatatccacccacattttcaaatttccagcatttttatccgacctttaaagatagtaaagaagtcagaatattttttaagtatataaaagtaaataattaccttattaatcagacaagactttactataaaaccaaatacctctgagttaacaatattgaatattaacatggtaaaaaggcatcaggatgagttcttttatggagaggtcctaaaaatatataatattgaagtgtatgtgtgacacaggtaagttatattgcactcagaagtgttggaaattctgtgagagattggtttatatttgagaacctgcgtgagtctaagatggctctcgtcttcttctagaaaagaacaaatgtgaaataagacccctattatttctttaggtcttactgagatttcttcttttgcaagaggatgtgagttttctgtagtaacaccatacttcgcattggatcactaggtagttatggactaatctagggctgagggagagatttttatgacacactttataatagactttcagcgtttttcagaaagaaaatcccactgaggatacaaagtttatatttttctttgactgtaacacatcacaataaagatgatactctgctgatatatgagattcatgttatctgcaggaaaacttaaagtgttttgttctatgtgacagtgacactgtgtctaagaatgctaaggcagagaaaaaatggagatttaggtaatatttatatagataagaaagaaagtttaggctcatagtccagaaagtaaactgctaattcttgcctagtatgtttttttttaatttttttaattccttgagtctcctcagttttgcatgattttgacactgtttaccagacaattctacattatctctccttgtcttttggtttgaattaaaagtaatttaggataatttcagtttacctaaaattaatgaatctaattctttacctggtaaaaaaaaatttgttctttgtcttccataatctgtccctctgtaattattaattttacatgttaaggtccagatatttggtcaaacactattttgaattctgctgtgaaggaatttttaagatgatattaacatgtaaattagtagactttgagtgaagcagattaacctccataatctaggtgggcctcatttcatcaggtgaagcccttaatggtggggggatggaaagactgacctctcctaacatctttctctcctgaggaagagggaatctggcagcagactgccttagacttgagctgcaacgttcattctttcctgggtctccagcttgctggtctatcctgcagattttggacttactagcctccacaatcacataagccaatttcttaaaataaatctatttctctctctctctgtctctttctccatccattcatccattcatccgtctacacattttttattgtttatttttctctggagaatcttgacggatacaccatctgtttatcaatcattcttgaaacagaaaattctacctgtgtatgcaccttgactggaaagagtttttgccaagtctgtactgtacctagttaaggcatatttagaaacatggccgtgggaaaacaaaaaacagcaagattaaaacatggagatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcgtggtggcggcgcctgtagtcccagttactcgggaggctgaggcagaagaatggcctgaacccgggaggcggaacttgcagtgagccaagatagtgccactacactccggcctgggtgaaagaacaagactcggtctcaaaaaaaaagaaaaaacatagagatatattatatatcctaattctacaaggatgtttctggctttacttatgtgtgtattaaggtttttcttctcttcttccacactattttcttatagttgacatatggtaatatagtaagaaaaaatacacatatatttcttcttgcaatatatattcattgggatgtttaacactgagtgtcaacctgattggattgaaggatgcaaagtattgatcctggggtgtgtctgtgagggtgttgccaaagagattaacatttgagtcagtgggctgggaaaggcagacccaccctcaatgtgggtgggcacaatctaatcagctgccagtgtggccagaatataaagcaggcagaaaaacgtgaaaaggctagactggcttagcctcccattctacatctgtctgccatgctgaaaatcggactccaagttcttcagctttgggactcggactggtttccttgctcctcagcttgtagacagcctactgtgggaccctgtgatcgtctgagttaatactacttaataaactccctgagaatatatatcctattctttccctctggagaaccctgactaatacattcatatatacatagttttatatatatatatatatatataatatatataatatttatatataatatatattatatatttatataatatatataaataatatatataataataaaatataataatatatatattatatattataatatatatatttatatataatatatataatatataatatttatatattatatgtttatatttatatataaatataatttatatatttatatcatatatagtaatatatgtgtatattgcaatacatgtatacatatgtgtgtacattgtatatatgtatattgcaatatgtatattgcaatacatacatatatacatatgtatgtataatgcaatttatatattgtatatacacatgtacatattatgcatgtatacatacatatatgtgtatgtattgtatacacatatgttatatgtgtatgtattgtatacatatatgttatatgtgtatgtattgtatacatatatgttatatgtgtatgtattgtctacatacacatacgtgcatgtattgcaatcagatgaaagcacacactgtttcagtctaataaaggcaaatgctagcaagaaattaatttcactgttaaatttccaattattttctagatcctgtagctcaggagcagcaaaggattacaaagaaacaaaatgctatgtgggggagagagtatgaggatataagagagctagcctcacaaaagatgttttttcctggcccatgagaatagcaacttgaaaggagaataggaataaacagaataagctaaataaaccatactggatttctttcattctagagatgaagttttatttggagtattaggattgaacctgaaattaaaaaataaaataaaggttatttccctggattccagtcagttgtgattaactaataacaaagccatttggttgtagacaatgtcacttatcactttcatgacaagtgatgacaatttggaatcatgcaactgtaaatgtatgcttgatatacaggatgcagtggtgaagaaatcagtcctggctttcaaggtccttatcaaacttgtggcatcctgctatttattgcaatcatttgcatccctcttatcccctatttttggagttctagctcattgcagtctaaggacagtaaattatatatattcatacaccacacaatgttaagcagataccaaacacacacacgcacacacacacacacacacacacacacacagagctgtataattttgctattggcacaaaaatgctgcaaaaccaatcctctcaaacctagtagcttaaagcatgatcaagtgaaatttttcatacacctctggatcagctgtggatggactggtctgtggctgggctggatagctttgctgatctatgctgagcttcgctgggcggtttgattgtgtctcttttactccaagcaggataacttgacattttctcatcacagagacagaggtactaggaaaacgagctccatcaatcagacatttcaagcttctgctatgtcatacctaacaacttcacattggccaacgcagatcacatgactatgtccaaggtcaaggaggaagaaggtgttgcaaagtcacaggacaaggtttcgatatctaatttcactacttggggaggagaagtaaggggctgaaagaaaataccgcaagcacacttcaagaatttaaagtgcacgcatgtttcttcaaactccatatatgtttataggttctttagaataacttataaaagcaagagttttggcctttattattacattgattagatgatatgcagagattcgaagatatcttcaatataaaaaccaccaagcatcatttaatgaaaattaaaagcagtatactccatgaaaaaatgaagcaacttttataggaatgctacaattcacagctgtgtagagtgacaaaattgttctcatgcccctcctagcatgcattaggattttcgttatgtgaaagttttcttcagagtgaatgcaaatcaaaaaagactgtattcacagcctttagtgggatgtactagagaaaattcactttttatacctactaactcaattttccaccttactttgtatactacacatctggcaagagcagacagtatgacttagtaaagtcaaaggacccaaaaaaacccctgctataacaaaatgctgtctttgagttgcaacttttgattcttaagggaaaaataaaactgtttttatttgtaaaatagaaccttacatgcattaaaatctttactaaggattttcacacacatatctggtcagatattcctacaatatcattaatatagcagagatttgttcatttcacaagtgaggaaataaaagctcaagtcaatgaaataaaggcttgatcttaatatatgtaatagtaaggatgcatttgacagcaaataacaaaaaatctgattgatgtggttttaaacaataaaaataatttattgttgcatgtgaactgaaggccacagttaggttgggataacccttggtttaataagagcttgacttttcagtgattgtcgtaggtctttctttttccatactttgaccacattcacaaaatattgtgcagaactgaaactgtgtgcatgcatctctgaatcggagcactgggcttcctgctcttggaaacattcctgacccaatctcaagggccatggaattctaggtggtgattgattggtgcctggattacacaaaccaatccctgtgtctgtgaactcatggagcacgttttagccaaggtctaaccctttgcgctagagaagaggaccctcacccaccattgaatgagcagtacacacaaaataaaatatgagggttcaaccaaaggagacggtgaagggagagttttaaccctcataaataacaggtataagactaaaatctgtcatttgtaccccttcctcagtgctctttcctatctaagataatgtatcctgtgttaattaatacacatttttataaggggttgttttataaatcttacctcttttctgcattatgtgaatagtaagatggagaatgttgcttattataataaagtgataactcagctaatattcttatttcttcaccctcattgagattttctatgaaatatcatttggagaacatttcttattataatgaaaagtgataactcagctaattttcttatttctttacctgtcattgagattttctatgaaacaccagttaaagcaaaagcctagccacttctaagatactgtattacaatattattatatattctgacacattcagatataattgtttacttgtctttttttgctgacaaaattcctgcatcagtgtaagtggccatttatttttgattcatgtagacaaatgcttagctctttaatgggagcttgatttgaaagacatatcaaatcgtacattacagagccatttcccctgaagattgctcctccacgtcagcaaatgcacatttggttaggaataaatcacgaaaatgtttatggctacgtatatgttatatatgaaacattgttaatggctaccatctttgtgccaacatggttttatgctggacaatttaaggacaatttccagtccaaagattttggtcatttttcagaggctccattatattttccaggctacttagaataccatttagtaaattgctgcctcagagcactagatgatgattttatcatttaaatagttaatacacttaaattgcctgacaactaaaatgcctaattacacacacacacacacacacacacacacacacacagaactagcctaccataacctcagacactacatttcactgtaggtcagacctagggtccctaagccacagtagaatgataatagtttagtcttcaacactaaaaggcctccagataccatgttatcaaacttcttcattataaggaaaagaaaagcaagtcaacggacctatgtgattaccaggtttttgaatattttggagagatatagctatcaaaactataaaaatttaagcataatttgaggagtaattgttgttccttcttttcataaaataacatgcttccaaattatgttggaagatggaagactgataattcaagggctaggggaagctgtgtaaaattgatcattgttgtagaagataccagcatttcatacatttctctgtttttttaatctcatttagcttcccaaaacaaggtgtagttattgcacaggttatataactctcaagtcagaaaagatccaaatgtcttttaaaacaatctcttaaggggtgactacgtcaggctgtaattggctgattgagtttcggtttaatattacaccttgcccctagcatccactcctgctgtctctaggcactgtccttttctttcacagatttgacattttcttttgaccttaacttcttaatgttccttcattttataaatgcttcatttttcatgcttgcaaaaatggagtctcttatataaggacacctgtcatgctgtcagttcatagtaaaaccagcaccataacctagatatcactcttctcctctggttacagtcattttatataataagatttaaaacaataaagttagtgtcattaatgtgtctcaaaattcaagtttttcagcttcctctaaacatttcttttctttgaatctataagtcttatttctcttatcactaaaaatacatacatcaaaataaataaaagctttcttctccaattacctacctagctaattctctttctacttcatttatgtcctacattatttaaaaattaatcaatgttctcttccttttttgctcattcatttctgcctgaccagcctcctaaaaccagttccattgagtcactaataatcttttatttctcagacctaatggatgcttttctatccttgagttatgttgtctccttcatgaatgttcatgaaacattctcacttttagaaagagcatgttttcttcgtttctctcctacctctttgactaaacttctttagcttctgtctcccccacccctgccaagcataccctgtagttttgtatcctacaattctttatatgtttaaccttccttcttgcttctctgccacctatacacctatgactttggagtctatgtgcctacaccagtgcttctcaaactgagtaatttagcccccgaggatctatctggagacatctttagttgtcactgctggatgatggggtgggaatattaccgccatgtggtatgtagagtatggatgctctaaacatcctggagtgcacagggcagcctccaataacaaaggaataaccagctagaatgccaacaatgtcacgctagaaaaactcttctgtagaccgtactattcttcaattcccaacttatattcacttgcttagttgatgtctttacaacaaacagaaagatctttcactgaggctttgaatgaaacatttctatatataaatcaaacataatttgcaactaaacaatttattttcccacattgccttgtgttagataatgaacttttctttaactccttctaagtatgtgacacatcttctccactggaaagttcttatttaatattataactgtaatgtcctttgatttcttctttttgtgataccatgtataatcaatactgtatgaccttttatacactttggtcactttttttgatgaggcaagggatgtattcacatgcatgatatggtcgtcacccacatacttactatatgtgtaaatagagggaaaaccaccttgggaaaatgttctctacttcatcatgttacttttaatatgtcaattacggcctatcatattttccaataatcaagctaatttttgccgctttttcacaaaggaggactttgaaaagttgttaatgaagctcagaccaccaacttttgcttttgggtgttgtcttagtctttttgggactgctgacacagaatacccaaggcaaggtggtttataaaaaatacatatttctttatttttttaaaaaatatttcgacttttattttagattcaggaggtacatatgcaggtcagttccatgagtatattgcatgatgctgctgttagtatgattgatcctgtcactcaggtagtgatcatagtacccaatgggtagttttttaacccttgtcccactctgtcccttcccaatctagtactctccagtatatattgttcccatcttcatgttcatgtgtacccaatgtttagctcccacttataggtgagaacatgtggtatttggtttttggtttctacaaagaacagatatttgtttcttatagttctagatgctggggagtccaaaaatcaagtgacccacttctggtgaggaactttttgctacatcaccccatagtaggaaagcaaaggagtacatgctcaaaagatcaagagactgaactcacagcccccaactcttttataattggcattattaatccattcataaagatggagcccccttcacaatcacctcccattaggccccactaccccacactgttgcattagagattaagtttccaatatatgcttttagggaccacattcaaaccatagcattccaaccctggtccccgaaattcatgtcattctcacaagcaaaatgcattactttcatttcaatacccccaaagttttagtttgttccagcaccaactcataaggccaaagtcgagagtctcctctaaagagaatggtggtgagagtcaaggcatgattcattttgaggcaaatgccctccaactatcagcctgtgaaacgaaagcaagttatctacttccaaattacagtgatggaactggcatagagtagacattctcattccaaaatggacaaataggcaagaaaagaggggtaactagtcccaagtaagtccaaaacccaatagggggaaaacagtaaatcttaaagctggagaataacttttttaactccgtgtcttgccttctcagcacactgggacaaggattggacctccaaagcatcaggcagcccatccctatgactttagcaggcttactccacctagcagctctcatgggttggagtcttatacccgtggctttcccaggctggagcagcatattgatggttcagcagttctgaggtcttggaggctactccactctcatgactccactaggcattgccctagtggggactttctgcagtgggtttgcctctgcggcaagtctttgccatggtctccagtctgtctgtaacatgctttgaaatctaagtagacgttgccatggtcccagagctcctgcccgctgtgcacctgcagaattagtaccatgaggatgctgccaggatttacagcttgtacctttggtggctcaagcctcacttgggtccacttgagccaagactaggatggccaagaggcactgcattcagagagcagagtcctaaagcaaagggcagtgaatcctgaggtcctgtagccacctctctgaaaactttgctctgaaaacaaggcaagtcctatcttgccttgaaggtctgtgaaatgcctttaaggtcgttcttctattgtcttaatcaatagaacctggcttgcttctacccatattaatctcattagcaaagagtcacttggccacacacttaatattctctgctgaacacactttttaattctttacatggccaggctgagatttttctaaatctttctattctgtttcccttttaatgataaattccatcattacattattgtctccttctcttattttactgtaagcagctaatagaagccatgcagcatcttgagtactttgatgcttaaatattacttctgccagacctgctagctcatagctcttaaattctaccttcatgaagtcctaggacatggacaggattctgccaacttcttggtgactgaataacaaggatggcctctacttcagtttccaatactttgttatttccacctgagatgtcatcaaaatgatctttactttctgtatttctcccagtattctgatgatgaccacttaaataatctgtaagaagatttaggttctttttacaactcttcttttcttctgagccctcagaagatgcacccttaatgctccctgtatagtaagctaggcttttatagcctgctcttccaaattcttccagtctctactctttaccctgtttcaaagcccttctcacatcttctggtatttgttatagcaacagtcccacttcccagtaccatttatttatcttaatctgtttggggttgcatagcagaatacctgagatggagtaatttataaagaacagatcttaaggttctggaggctgggaagtccaatgtcaaagatcctgcatgtggtgacagtcttcttgctgcttcccatggtggaaggacaaaaatgcacatgcatgagaaagcaagtgataggacatgcaggctgaagtctttcataaacagtattattccatttataagtatggagctcttctgaccaaaacacctctcgttaggccccacttcccaatgttgttgcattggttattaaatttccaacatgctttttggggaacaccttcaactcatggcaggtatggatgtatgtgtgtataaatacataacaaacacaaatatatatatgtgtgtgtgtgtgtgtatgtacatatgcacatacacatttatataaatataaaaacatctatggtttcctggggatattatcttggaatcctgcattttttaataagtacaaagtgattaaatgtgagctcatattcgaaaaccacttcctttgccaaggcccaggccagtcacaaaagaggttattagcatttcattagttggattttctctgttgcgtctattaaagagcctccatttcccccattaatacagtgggtttgttgtcagagggtggcagcattataaataatgtgtgcacttttaggttaccagtttggagactaggcctatgttctgaatgttttcctgagaccatatggataatcttttggcatcatccagactcaaaccctctgactgcttctaataatgctggtgctttcagtggtcacaaaatagatcacagtctcaaggatcaatgtaagatttgaaggtaaggacatctttatgtgtagagggacattttctgatctggtaaataacttatcaagctgaggtgatttttttctcagttgtctcccttcccttatcaacacacatctctatttcaattttactgatttatgtactttactgctgtttaaatccttcattgtagtgcttggagcatctaggaacatatgtgcctcaaagcatcagtaaagtgtggtaggtgtctttgagggtgcctttaactgcaaggatggacatgcactggtttagctctgattctggtatcatctagtgatatctagtttgtgtctacgttcccccattttgtttttaaaaaagaaaagagttaaagaatcctgagcttactaaaattgtttggctcgcacagtggctcaagcctgtaatgccagtactttgggaggccgaggcagatgattgcttgagtccaggagttcaaaaccagcctgggcaacattacaaaaacctgtatctactaaaaatacaaaaattagccaggcgtggtggtgtgcacctgtgctcccagctactcaggaggctgaggtgggagaatcatctgagcctagggagggccaggatgcagtgagccaaaatagcgccactgcactttagtctgagcaatcagagtgagaccctgtctcgaaaaaagaaaaaagggttggggcggggggtgcggtttgatgtttattaagctttgaggaaggattcctactgtgagcatggaaaggcaggtggcgataagtgtgccaattttttcaccatttctgacctggaagttgtgaaatatttactttatgcaaactttactactgtatagaaaatgttacatgtccttaaagttgtgtagttaaaatactactaggtataaagggggtgagagaaataactgacatgaatactatgagcctattctaaatacactatttcattcagtcttcaaaaccaccctatgaaaaatgtattgttattcttatttagtgatgaggagacaaaagttcagagacagtgaatggttttcttaaaatagttcattgtaatagttggtgaaatgtttaaatccaggtctgcttgtttcaaagcctaaatgttttctcttaatatgttacagtctagaaacaatgattaagagaatttgagagtatgaagggaatactgtggtaacagcaaagctggaaagatagaaaggaccaagcaatagtagaccttgaatatcagaacaaggatttaatttttttaaatattatgcatttatgtatatgtatgtgttttcatatttgtaccctatcaatagtagaaaaatattgatgagaaaaggtcaacttattctaataaaaatatttgaaatgaaatatttcaaataatgaagaaatgtgtacacaaatatatgcatatatatgtacatatacatttatgtgtgtgtatataaaaattttgagtggggaaatgacagcacatgaagtttgtttcaagaagtttgtcctggccacacaacgtgagagatgttagtagatagatatttgcgagactagctaagggatgcttgagctagctcgaagaaataatgagagtctaaaccaaggtagtagccttgggaatggagagaaggaatggatgggagagattatgagccataatgctagttgacataatcagtttctctggacagtttccaaatgagacttaccttagtgaaaccacattcttacacactcataaattttctaagtaagataacaaaccaggttcctatgtaggtgctaaaaggctataattaaaatcaacccacttatttaaaaaaataaaggttaaggaggtgacttaattgggccacaggagagctatctatttatggtgagaacttcctactcaaaggatagcacatccaaaggcagtgctagtaaaacatttgagagtttggaaatacgaatctctgaactaggttattctaattccactaattggctgccaccacctgcattaattgacatactgacatcttttccctgctagtcccaaacatatgtggccacattgcccaaagtacacaaattacccactaaagtcagtgaaacttatggctcctgccgacatggtagctggattattattattatcgatccacttggctgcatcttgtcactatgtcacagctggcttgcagtactaggaaagaactattgcatatgcagaatcttgaaagccatgggaaaaaaaagtaagtggggaaaataacaatgttaatggcctcataacgtgctgtgcttcggtttaggacaaatgctggtgagaaagtccaatccatagtttggcggagagagtgttggctggcattaatgcaaaaattttatttaaattttaattatcggtggataagtgttttagattttgtgaacatccaatttgtaagttaattttggagtacctaacccagaaatcacataatctaaaatcattctaatgagtttggccgtgactcaattcacagttaaaggagagacgttactccaaatttagtctcatttttggatcatgaaaattcttagattgggtcatacacaccatggtgccgagtagtgcttaattaacttaataggccaagacttcattccacatgatcctgtgggatttgtgaaagcgttggtagccgagatagaagccaaatcaagaatgtaccaccaggtggcgcttaaggacttcctttcttcacatgtcactcagtcaatccaggatttattgatgtgagaaagtgtaacactagatacgcatttccagaagggtggcatgaaacttctttaaagatttcagaaataatatagtgtttctaatcataggattgggtctatctatttagtgagcgagaccactctctacacacacataaaggagacaaatgttatcaaacaacaatgataaaattacgttttgtgagacaactgtgttcattaacgcatttttttaaatctcaaaacatacaacattatttcatgttcaccatctcatttcttgcaagcggcctatcaagtaagtagtatttattattgtcattcttttcctagaagaggaaataaacaccctaagagattaatcaacatcacacaattggttaataacagagcttgtagtgtaatccaatgatctactccaaagcctgaaatcttaaccaatgtgtccatctgcctctgatatggcactggttaaagtgtagatgattgttctagttttcaacaactggtgtttaaaatttaggggaaattttaaagttttagttgacattaaagttgcattgaatttcctttctggtaaaagaaagaagcaaaaggtggtggtcaagtatattcagtaatagacacagaaagactataatagcaagtataatacacttgggccgcctttgtgaattaatttaaaaatgattgcatgcctggaattgcttaatatgaacttcccaatagaagaagctttgagttaccctttcttgttaataggattgtcactttttttctttccaactctgaacagcagataacactgtataatacttgtcccaacagaggctccaaatcagtagaggatggaaaaacactcttattcagagacccattttctttgttttataaaaacctgttgggaagaaggttaatcacaaacagagatgtaattcggcatagggaagacttccttccctattttgacaataaccttaatcttaattacttgattcactccaaggaagagtcagattaatgtacctgttagaacaccacctagtttctctaattaatgtaaattgtaaaatgttcaggaggtgttagaaatcagaatgtagtttgttcctataatttgaaaacatcctaatcaggatgtgttcttggaggaaagggctctttgtgtacctctaagaaaaacagtgaatttttcaagaaaaaaacaaaaaggcttgagctgaagtcacattggggatgttttgtctttctgagcacaggcatataaaataaaggaacccataactgcacaggggttggtctgcagatatgatgaactcctctaagtcatccagggcttataaaacaaaggaagtgcaattcaattctctgaaaatactaaactcaatgtttgatcgttagcacacagctgtcttcatcaccacccccactgccacaaccatcatcatcatccaaagtcattataattgtttaagatgctgcaaaagtagaaatgaaataaactctgtccttctcacctgagagttgaatatgtagatgtagaagataaaggaaagtatttattttaatgcacattttgaacacataagttttattatctttattatggtattgggtaaagtgatgtatgcagaaatattattagaggcaaaataaaccctttttctaataattttattcacttattgtcatagcccatttattgttactataaggaaatacctgaggcttggtagtttacaaagaaaatttggcttccaattctgcaggctgaacaagaagcatggcactagcattctgctcagcttctggtgagggtctcagtttgcttccactcatggcagaaagtgaaggggagttggcaggtgcagagattacatggccagagagggagcaagagagaggggagggaggtgccaggctctttttaacaaccagctctcatgggaactaacagagtaagagctcacccaccctataggaacagcattaatctcttcatgaggaactcatccatgatccagacacctcccattgggctccacctccaacattgggatcaaatttcaacatgagatttgatggagacaacccatcttcaaactataacgcttcttttaggtatattatttatatataattaatatgttatatataatcatatatacacatataaactatataattatacatatataatatatatatgtatatataaactgtatataatatatacataaatacacatatgagtatatatgtatatagtatatatgcatatatacacatataaaatatttatataatattcatataaatataaactatatatgctctatacgtgtgtgtatatatagtatgtgtaattttttacacacatatgcacatatacaaactatctgctatttactaaaacactttgcttggtagaaggaatatcaaagtcaacaagacatatgaactccaggaacattgcatctaataaagaagacaagaaatcagaaaaaactaccacctgtgaaacatgttatgctacagttaagtataggtagctgtaggagtatataagagagtcctccaacctatttttttgaagtgtttgtaagacatgatcccaggaaaaggtgacttataagtcaaagacagaataagcattaactgggcaaggggggaagttccaagcatttcagtctgcaaagacccagagataagagagtgatgagctcaccaggaatcctgagtagctttctaaggtttgagttaagacagtggaaagagactggggagagaggaggctggaaaggtaggcaggggctcatcataaagggccttcttttgctgtgaaaagtttaggctttatcctgcaaggtgtgaaggacacattaaaggatttaagcaaaacacctttgttctttgtgaagatcactcactccagatgttgtgtggaggaggaataggtgagtaagaggggaataaagggttcaaggtggtgatagctatttgaggcagagatatgaatatgctgactgagggaacaataatggaggtggacaaatttggatggcatcaaagtttagtacaggaatcatgttaactggattaatggctgaactcattgtgacactcaaaatatagaatagggttcttttgagacctaagtaagatgtgtaatttattcttaagataaactggtggtttggccctatattttgaagaaaaaacaatttgttgctgcaaaaagatggtgataagaaaactgggagttttagaaatgctggaggtcactgaaattgtaccgacagatttctaattctcttatctgggaatcatgtcttcagcaacttccaaaattgtgaactcacttgacctcggatagacaagcaaacattgattttgagttttcttaatggaggagctttgcatcatgtactttacttggggagattctcacctctatttgcttgctacgtctgttggcttctctcttagacgtggtcataacatcatcacttagctggttctccagcttgaaggggactagaagtactaaaaatgaagaggaaggtgggaagcaggccctctgacagcaggcacctgaagaaatgatggctgatatttattgtttgatgaagtctccatcatgtgctttctagatgcctggtaccaggtgtatcgcccatctgtggcatcaacacttggggattcagctggcaaagaaaaaaagggcattctttataatacgggtgcaagatctgaagagaacagacaaatttgaatcatgcaacattatcataatctcatattttactacccacatagtaaactggcaatgtgcttagtgacaaaagtgttaagaatagaatgaggtgtactagatgccacttcttagagagaaaggagtctcagatatttctaaagcatcacatcagaaatgactgatcattaaattggtcaaatatggattaaaaaaagctttgcagttcttaaagattttatttagttgaagaggagtagctttactgctttatggaaaaaccgtagtgttcgtttttcttcgttttcttcttcccctttgtttaatatctaaaagtttacctcaaccagacaaattctcaggtgtaatgagattcatttttgtggattctagagacgttgagaggtgctttattagctcagtttcttgaggattgcagggggtgtttgggcaccttttcttgactggttttatgaaagatgtgggggctgctttcccatggaaactccacctgcctgtagaagctctggcataaaatgatgggatttccagaaaagattccaattttaacttttcccactcaatggccaaactcctaaaaaaaaaaaaagggaggggggcatcaatttactgttccaatttggtcatgtttcattcacattttaccctgctgtaacttggcctcacagccatgccacccttggaacagttctcttcagattcaaactgattcctcttaggttactcccagcttatgtggcctcttggcagcattcacctccctttactataactttttcttgaaacaatggcagtgctctattttttccataatatttattatagctttaagggcatgtttgtgtggtaatttggtcagatctctctcctccattagacaagaagcctgctaagagaaggctcttggtctgttttacttaccattgtatgactggcaactgctggttgccacatagaaagagctcaataaagtgtattgatggcatgaataaatgaagggctcactttaggctagctttacaaacatgaaactgaagcaaagagaattttctaccttctaaaaattgaagccaatctccctatactagtttaatgatacaagtttgataactcagtagaaaatgtccagtaataactttaacttctcgtattcctgtcaagttctaccttaagacaagaagtaggcacaataatttcaatatctcaattataatgaatgataatagtaaaaatatttaatgatggatataacatgggcaatgagaagtttaaacaactattggctggaaacaatttatatggctctaaagctagtatacgctgaatattagcctgctgtggactgaattatgtccttcctaaattcatatgttaaagctctaatgcccaatgtcactgtatttggaattaaggtcgttaggcgtgaattaagattaattaggtcataaaggtgaaaccctaatcctataggattggtggcctcataagaagaaatagatctttctctatctctcttttcccatcccttcccctatgtgatcagaggaaagaccatgtgaggacaaagtgtcccacctgcaagctgacaagagagccctcaccagaaactgaaccctgatagatatgatattggacttttcagactttagaatggtgagaaaatgaatgtctgttgtttcagcctcctaatgtattatgtatttttatggcatcctcagaccagttcacagctctaattaatcatatcaggtacctatgtaacagacaaattggcattgagcttattattttttttaaaaaagccacaatgtttccagacagaaatcttctaccatttttataacatttatttaaaacttaaatatccattgacagaaatactcttctgatattgcatacccggtactcacaatagaaagaaattactttttctagtatgtgtatcctggaaaagcccatgtggttttctttcataaaataaagcataatttgttacaggaatttgcttttttttagaaatgctacagtacaccagttgtcacagtgtagtccttgaaggatagttctgcaggtgctccaaaaaggtagtcttgattaagtaagtgtgggaaatgatgctttattaaaacagtggtaaatgggtttattttattgctggaccttttagactctttcacaactagtgtgttgggtgaatttatcaataatgtttatgggactctcaagggtagatagatatataatgcaggattgtccaaagtcatttgacaaggagatccttgcttcacaacacaaattaaaaacccatggaactgatgtttttcaagatacgtatattccacagtaaatcgtagtgtaaaattaagaatcattttgcaaaggaaagaatcactgtatcaataggtttcagagcagaaaaaacaatctaggtatttccagctactaagtaaatcacaatgctcctcagtcccaaatatgacacctgtcaaagagatcaaaggacatggagtctgctgtgctcatggtcatatctgcagagaccaacacatcagcctccactgctggagaaagatggctcactctctctctctctgtatcttccacattttgtgcaaatgcatcccattggcagatagaaattgaatccagagccatggtagtctatgaaatataatacctagacttccagcctcagagttatagagttgtgaattgtacaattctggatttctatttattttgtcactgaaactcactgtaaatcatattctgagacttcttacatcctgtttccacactccttttccttattccctcagggaaaatagacaactaatctctttaacactttcttccctgcttgaagaaattgtaggcacacagtaggggctttgtaaatatttgttaagtgaataaataaataaaggacatataagttgttatgtgattcagccaagaggaaaatactgtgaaatcagaagatagttaataattgattggcattgatgtataggcttcagaaagtgtcacagtggtttcatgaattgactttattgatgacctatttcagttaccgtaagcatacctgtacaataaaattgaattaacgtgtatttactaccaggtactcaagaaaaacaataagcatattgaatatgagactaaaaaggataagacaaaaagagtaacaatcaatcatgaagcttctacaatttcttcctttcttttctcctaacaacagtggtcaatgactctcaggggacctgacatacttctactcagcatagatgggtcttacagatgatggagtctcaatgagtcctcctggaatgtggcttaaatatgcaggctttcatctatccctctatgagaagccagagggcttgaagtatcagataaattgtataaatgtaaggccaaccctatcagccatcaatctatgtcaaatttcaaaattatcatgtctttctaaacgtttcctatcaatgaagagttacatttcttctggctttgttagcccacattattacctcagcagtgtgtgtgtgtgtgtgtgtgtgtgtgtgtgtgtgtgtgtgttggagaggaagggcttatatctcaatatattattttattttaaaatacaggcaaagtaggggggagtctatatgactaactcaaatactgtcactcactggggtgaacattctaagaaatcaaagcattctcctgagtgtatcttcttaatcagcaaagtattatatttggattttttcaagaaaaacaaactccctacctaaactctgaatgttagtatggccttggtctctctgagagagagagagagagagagagagagagagagacagaccaagaaggagagagagagagaaagagaaagagagagggagagggtgattgatctctcatacatcagtcactgtgtcagagtatcaatgaatttcttagagtatccctctaaaaaaagggagaggagagttagaaaaagagaatgtacaggtaataaccaaatatttaatcatcttgtaattttctagatcctcttataggttctttgggaacatctgactagttctggtcaatgggttatgagcaaaattcacatcaacattcatggcctgggggtgaatgattttctctctcattttgccaacatcatttctttctctgattctatgaacttggaggccacacataccaccagtagaggctagaaaaatgacgtctgacccacatcagatttggtgaaggagaagacaagaataacaacaaaacacacacacatacacatacatatacacaaacaaacacatattgtgttacccctcaaacatttcaagatgtattttagaaaggagtatagattaccctcacaaatgaggggacagagggtgtcttcttaataaaaattccacagacaggctaaattccatttcaccttttttgaggcaaactcctagtaagataaacagaaatgggattaaaaatatccatgaatatatcctggaaattgtatacaatacttcatgcacatgtgcttttcatttccctggagagaggatagataacttacattggagcctctaaaaggtttagggtccagaaaacatcaaggaatacaatgtgaaaaatcgcccttatttagggaattttgagtatctgtggaatttgaaaatcatggaggcagttaccaaaaggcaagaagcttatttaaatctaagatagcctctttgggctattgcatgtctatggagcctgtgcatttggaatttgggctgcaagaagcaggcatgtggcaagtgatggacgcaccagtgatgaggatgaatcatttgaagccaagaggcctgttcaataatgtaacacaaagggattaaaagaaaagaggaaagaaagcactgagtagttagtctttgtgcttgcaagtcttttgtttccttgtaatctccttaaatgtgattgctgtgatggtgaaggctcttatatttaatagactcttgagttactttggagatgagacatattttccacttacataaaacacactttgtaccagaacacagatgctacaattgatacccccacgtcttaagagaaaatttgaaaaagagtccccaaagatttcagaactgcctttactataaatgaaagaatgattgcagttatactaaactccagtattaatgcagcagaaatagaagaaccaaagatggtgctatttattatttcccctcttggagagtatcagcaaaaaatgtttttttttttttaaatgcagttaaccctggcaaaggtaactgatgcaggtacacagatttgtagtcactcctcaaattgtcaatacattgtgctgtttgctcagcaggtgccctaaattgtgaattttgttaacgaagagttgtcaagaagtattggcttcatttagaaagcgatattcttctcagtagccttagtcttactttaggaaatccacaggggatacgtaacttaagggttcagattgggaggcgcctattattattccccaaatctttgcaggtgtccccaaaagcataaaagattaaattatacgtttttttatttgtcgactgtttcaaagtacaaacctataaaaggggaacactggtactcttttaaaggttatagggcatgaaaccacctttaacttacacgaaatgctttgaatttgtataatttgcttctcagatctcaaaacacttggtcgtatttcactgaatttgactcatccctttgggcaagaaaggttgaaaaaaagaaaatatcttgcactacttgctttctaaagccactccaggatgaaaaggagatactgaatgtctttgtggctgtataatttttagcaggggccattttctgtgcattcttattagaggaatatgtaggaatggtctgtttatacaaagacaggatggattatatgatatgattttgaaaatgaggaatatacctcttctaaaacacccatccagtctaaaacagtgtctgaaatctaagattcaaaaaaagccacttttttttttattttagggaattgtgagcttctatagagttgtcaaaacatggaggcagttaccagtgtattagcagcacattacccagatgctttctgaaccattaaatagggatcacaaaaagttattacttcactgaggacttttaaggattaaataagatgagacttgtaaagagtttaacatagggcatagggcagagtaatctcagtaaatgttaacaggcagtactagcagtggtggtagatgtcaaagtcactagttgcacccaataacatttttgcacctgttactgcatctatagatttataaaatctgaacgttagagacaatcaccaggtatgcagagtaattagttcatttcttcctcacttccttccttactctttccttctcattgtctcttccttacttcttctctccttgtttgttcatgttctttaattcatccaaccaacaacatgcagtgagcacctatttacaggcattttggataaagtaaagatcgaattaagcacaatcactgctcatgtgaaatttacacatgagagaatagaggcaaacagcaaaccacaacattcagaaataattattgctgaatgtgacatgcattatgagggagttagcataggaggcattaacgggctgaaacctagacatctaaccagaagaggggttggctcatgtatttgttcatttcacagattagtataaagctttaatctgattatttcctgagtttcttgctaagggatgggcaaacaatagtagtaaagacagacaggtatttttcctatttaagttctcattttagttttcaaattttgctctaagaaactctaaggtctcataaatgctctgaagtgccactggaagctctaacacctctctgaggaagaggatatgagctgagactataaaaccgcaaactcacttgaattggagtacagccaacctttactttgcacagatcatgttaacacaaatctgtgtgtgtgtgtgtgtgtgtgtgtgtgttggggggaacctagttcttactttacccaatccccacatgttctgatatgcaatagtttcagttagtagggtatcatgcaatgtgtggaatacccatatgtcttcttatatatgcttggcaaaaagtatgctgctagaaaaataatagcagccattgattaacttccattctggggcataattttcgagttcaagattgttacaagaatttatagctttaaaggactatcctatttcccctatacttcctgggctaaatatcccattctcttaaatttttcttataagaatcagacgaattgccctcactaccctggtcacttctttgcacatgttttttcagtgtttgccaatgttcttcttaatgcttgggacccaaaacaaaaccatgcccgttttgccattagaaattcatctgtatcacccttaagttggtttatcagagtgggagacaaatctatgtaattttttattgtaatcttagtactgcagtgtagtacctagtttctaattagtactcaatagttatttcattaatacatactccaaatgtggtgtaaccaaacacaacatagatatctgcttttataactatgacactatcacattaactttcatctagccacatgacacagttgattgattttatgtttcttatcaatttatcaaatcagcttcttctcatttgtgaaagtcctgagggaattgacacaagataggtaaagtttattgggaaggaattatgagaactaataggtgtgaattggaaaagtcagatctgagtaagattttaaagtgggaaggaagcagttatgaacatcatgacctctctcccataaatactttgtgcttggagaatgaaaagaataaggaaatcagaaatacaactttcacatatttctgaaaatgccaaggcatgatgcagatgtttaatgggtttatattttaaaggttttgcattatagtattgatttgaataatttgaaatttcatacaaaatttcattacctgttaacttgatgaaattcactgaagaaagaaagaaatgttacagaaatggactacaccataatgactttcatattcatgtgagattgttaatgtagaccaattgggacttcaaatggtgtggtagaaaatgctctttaatgccaaatctgggcaaagcaacttgtcacatatgggaccaagcttaaaacattcattctcaaattataaattatactcctgagaatttatactacaaaaataatgcgaggacatttaaaggcttaggtaaagatagtttatcataacattcttgcgattgttagaaaagagtcgatattcattaatatggggcaagtaaaacaaaatcatggttaaatctatgtgatggacaatcaattagacttccacaaagaggcagagcagtatgtatagtaagatacctttaaacttaaaaaatgcccggaagggtaaaattaaaactaataataatggttacctagaggaggaagagagaaaggaagaaactagaagaaacagccttgattatttattttcaaatttggaaacaagcaaaagtttttgtcttgttttgttttgttttaagatggagtcttgctctgtcacccaggctggagtgcagtggtgtgatctgggctcactgcaacctctgcctccccaggttcaaccgattctcctgcttcaccctcccaagtagctgggattccaggcgcgtgctaccgtaccgagttaatttttgtatttttagtagagacagagtttcaccttgttggccaggctgtctcgaactcctaacctcaagtgatccgcccgcctcagcctcccaaagtgctgggattacaggcatgagtcaccactgcacccaggcaaacaggcaaaagttttctattaatcacataatgtgtgggaaaaaatccttaaactccaaagaaaaatgaaacagaagaatctgtgtataagttagtagcttaatggtacaaagaattatttgaggatactttgaattttagtaatttgtgcagctttgtgaaatatatcttcatgacaatgagatatgcccacaatattaaaatttgtatgtttcaatatttttacaatatatgttgtttttgaattatcatccacatacttttgcataaagcaactgaatactttttatgtcattagagaagacagctaaaagaaatataaagtcaatgaagttaagcaaaaatcttataattcaacatttgaataaaaatgatcaaaatgaactcatgacgtttcttatcttaacacagtattttctacatctgtccactgaaaaagtgtagaaatgatgactatcccaatattactgaatagccccagcatacagattatggtctctaaatgccattgcccagttaaaaggaaatcagacaccttagacagatggttgatcccaggttttgggggaaataatatcctataaaaatgagcctggaatttctttcaaaaaccaaaagcagcaaagccgcctggacatggtggctaacacctgtaatcctaacactttgggaggccccagcgggtgggtcatccgaggtcaggagtttgagactagcctggccaatatagtaaaactccatctctattcaaaatacaaaatttagccaggtgtgatggcccacctgtaatcccagctacttaagaggctgatgcaggagaattgcttgaaccctggaggcagagtttgcaatgaaaaaaagcagcagagccactattactgtaatcagatcaaaggaaattatagtcatttttaagagcataatcccatcccagaaaatacagaaaatgtgaacattagaaatagtaataagattgaaatgtatcaaaatgtaaaatatgtaagtgcataatgatacaaaaaaagatggataaggaaaaataagcaagtttttctttatcttttctatgcaaacaatacctcaaggtagctaaagagtttctttatatagaagtatttcagataatcaatgaaaaataatgacaaaattagattattacaattttgtactcactaatacaaatatataattaataattgctaaaatccaagttttggaaagctaatggaaagctttaaaatggataggtcaggttgtcaacaccttttaaccttaggaatacacatgtgtgcatgcgcatgcacacacacacacacacacaccccacacacagaaatcagaaaagacctgcctactgatatgtacaataggaatcattaagcataacttacatctgtaaattacccatgccaaaatattgaacctcagcctgatcaaaccttaaaatgtgcttatcagtttgcaagacacacaaaggagagagcagcattaaaacaaacaaacaaacaaagaaacaaaaaatccccacattcaatcaatcaacaaaattcagaatgtgagaaattctttaggacaaatgactgatttatttaacaaattaatggcaagaaaaacaaacaagagtaaaagatgaaccaagagataaagagacttaagagatgtcaaacaaattatatgtagtggatatttttctttagtagacatttgaaaactcaaaatagtaaaacacttcttaaaaagaattagagaaaactgaacattgactacatgatataaaaaatcattttctggctgggtgcggtggctcacgcctgtaatcctagcactttgggaggccaaggcaggcggatcatgaagtcaagagattgagaccattctggccaacatggtgaaaccctgtctctattaaaagtaaaaaaattagctggacgtggtggcacttacctgtagtcccagctactcgggaggctgaggcagaattgcttgaacccgggaggcggaggttgcagtgatcggagattgcactactgcactccagcctggtgacagagcgagctccgtctcaaaaaaaaaaaaaaaaaatttctaatgcattaggtgcgattatggtattatagccagattataaaatagatcattatttttagatatgaactgaattgtttatgcatgcaattaaatcatatctcagatttgacttaaaatagctcagtttagtgggaaaataatgggtggtggtgtggatgaatcaagattggacatatgttggcaactgtccaaattgagtggagcgtataaggtgttttaatataatattctaattttatatatgcctgaaaatttccataataaaaagttaaaataatatttttaaatgatagaagagcaattagttctgggttatataatttatggattttttatttttatcattatactttactgtataattttcttagtgagggtatattactttcatcttaataaagaaaagatatataaattttaaatgaactcaagactgaatctgagctgatatatccaggagcaaatcccttgacatttgccaagaataactgtgttagttttctagggctgctgtaacaaagtgacacaaactaggtgtttcttataacaacagaaatgtattcttaatagttctagaagctgtgagatccagaatcaaggtggctgtagggccacatttcctttgaaacctgtagagaagaatcactccttgactcttgctaatttctggtgactgctgtcaatcattggtgttcttgatcttgcagttacatcactgcaatctctgcctctgtcatcatgcggtgttctccatgtgtttctttttgtgtctcatttcctcttataaggacaccagttatattggattagctcacactactccattgtgacagcatcttaattaatcatatctgcaaatatctcatttccaaataatttcacattctaccttactggggttaggacttcagcatatctttttaaggaaacacagatcaacccaaagcaatcactaaatccacccatgcatcctgaaataactgtgatgtactaggaaagtatcagacatacaactgaccaggatttaaattttaaataagcccttcattccttgtatgaactcaggtttaattctttgaatcatactcaccttggctgatcatcatcatcatcataatcatcatcatcatcaccttaattgtcttagatcagattatctataataaagcctaaggtagagtttgtgtgctaaatctttgttgagaggtaaaaccagacaccatgctgaggagaaacttgcttcatctgaattcaaaagtggaaaaaggaggcaaagtctttggtgggtagggtggagatggataatggcagataaaattgaagatgtttccaaatctagcccttagtattttaggagactgttttaatagatgtggcatatgagggcatgtcctgaaattttcactgggaaacagctgaggttcgggagcaggtagactcatcaaatctggagtagcacataaactgggttcaataaaaactcgttaacttatagatcagttgtgatgaatatatgagataatacatgaatggattctacacttctatgcactgcctggtttaagtcaggcactctgtaaatggttattgctgtttacttagacgggccacatcccaactttcagagagcttacgaagcaaaaaaatttcaaatttcttcaagagttcagcctaagctgggaaaagagggggcacaccatgtttaattgagaatattttattttaaagccattatgatttgaactcagtcactgaactacatataactaaaagacaactgatttcacaatttaataggagcatgaagagaagtgtgccttagattaaagtttgtgcctttgaagtatcataaacaagggttcactcattgatgaatgactcatttttatttatttatttattttttgcaatgaagcaaaactcttttcatttaccatctcttctcccgctcctccccctcatcctccttaattcttcttatagttaaaagcctgggctttggggaaaaggagatttaagaattcaaatcccagctttgaaactcaaaagctaaatgcaaattgtttaacttcttaagctttagcttcctcaattgtaactaacaagttacaaggattaagtgaaataacatatataaaatgcttagcatttgctatccattaacagtgtccactgttcatctccattttcaaaatctttcatgtctttctcgtctccagaagtgaccacagcagctgcataacggccacctttctcccctaccttgtaatctctctcttctctctccttgtatcgtaacaagagagagccctctcgaaggtaattctttccatttcattcccttccttaaattcactcagtgacttctcattaacagaagaccaacaccaagtttctaagttcgggccttacttcttttacttcattcctcattatctccataacagacacatggacactatctgccatagacacttggatctttctcctggacctcgacacctgcaatgtccttgacacctgcccttgatacctagctaatttctgcttgttattcaggccttagttgatgttgctcttccaagccttcaaaacgccctgtgccatggcatttatcacatcattttagtatcagtcctctgtctttcctctctactatattctctatggtatctttcatctctagtgttctagatacagagatataggagataaccaataaatactgtagaatgaatcagtaaattaataaatgaatgaatgaatgaataaatgaaggaacccacacaagctcttctttgcaaatatggtcaatagagtattgtctaatttgcaaaagccttggagtaacattaactgaaacttatagcaaataaacatcttgaaaaaataaggtaataaaatatcttaataagaattaggtttgacataacctaggctctgggttcaccctggaagaacactccagtggaagtacttagtgcccgaaagttggcaggacctcctctaacaggggtggctgcacagatgttctgggaagcagaacactgaagctccctgctttaggataaatggtgaaggactcaaccaaaaaatccactcctttcctacttacctctgaggccctggagaaggagcatccttagcagtgacaagggtatattgatgttctaatgttttccttaaaggcataaaacccaggatctaaatatttaccagcctatggaagagaaccatggaaaatgaccactattaaattttttactaatcttggaaactagtctttcagtatacaattttaattgattaagaaaaatagaaaactatgacttcactttcatggtcattaagtatcacacaccatccatagtgtttacacatttagttttgcataattattcatatcagaaagtttgaagaaattctgtcccctgtgtttgcttatgataacttcataccagcgcacagcaaattccatcatgttcctttaatttgattatctcagtttatcgccatcatatttctgaaatataagtgctgggattattgacttagttttcttacttgtcccctgccatttcctttgtcttttctaagttccctttgtttataattctcacataatgttaaggaggaataaaatcaaaggatggaaaggagctaaagttgatttttagcatagacaattgaaccaaaggtagtctgttattggggtaaacttctactttaaagtatcccaatcaacccactccctgaaattaaaaagtgtcttaagatatggtaactactctagtagatttttttcattggtatgaatttgttcatattaattttaccctttggcttaggacaagggcaagttaagggaaaatactcttccgtcttttcctttccatttgttcatcctgaaagactattttcagaaaggaagtttttattattataattcttcaactacagggtgaatgtaaaatacactctgtgagctagtttgagaagccatataccccacataacatactttctaaatgatgctgcactgttcttccccaaacactgagttctcctaagtcagaggctgattgtgaaagagaactccccttacctaaaatctacttctgaggcattaatctagggtttccaatttatgtcagctaattttatgtattagaaccatcatccaggtattctccagcctttccttgaagtgtcatttctgaataataatcttagaatccactttcttaagcatgtttctcctctccttgaatatctcatagcaatggcacctgagttcagtatgttgcatttattttaatgtttgtatttgaaaaactgtgaatgcacaattcctctttgaggataccacatttcttctatgtaaatcacaccttagaaaatattaaagattttaggtttttaacccattctaagtgttcctatcatttaagaatatttccacctcacaccttaacccagacttaattgtacagtgtacaattacactgtaagtggctaattaagaaaatgctcaatgtactgtagttgagagaacttcctattcagggaattcgttctactctttgttaggagttgcaaataaaacaattcaataacctgaatccgctccaaacaaaatactaaccaggtatcttcacagaggcataattccagctagaataaatgtgcatgaggattatttctccttcctcctactgcctcatcctattattatccagttccacatggcagagttaagaagcacagcatctgcatttctcagattgccagtcttcttatcctgtactggtaggatgacatctatttttgccagcggtgttgctgcaaccgttacagcgggtcttcctttctttataaaatgaatcaaattacaggtgcgcagcatggttgagttcagctgtatatctccaagttgcacgaaaactaaagctgtctttaacttaacatagtattggaagttctagccagggcaattagacaagaggaaaaaataaagggtattcaaacagaaaaagaggaagtcaaattgtccctgacatgattgtgtatttagaaaaccccatcgtctcagcccaaaaactcctgaaactgataagcaacatcagcaaagtctcaggatatgaaatcaatgtgcaaaaaccacaagcattcctatacacaaataatagacaagcagagagccaaatcatgaattaacttccattcacaattgctacaaagagaataaaatacctaggaatacaactcacaagggatgtgaaggacctcttcaaggagaactataaaccactgctcaaggtaataagagaggacacaaatggaaaaacattccatgctcatggataggaagaatcaatatcgtgaaaatggccatactgcccaaagtaatttatagattccatgctatccccatcaagctaccattgactttcttcacagaattagaaaaaactactttaaattttatatggagccaaaaaagagcccatatagccaagaaaatcctaagcaaaaagaacaaagctggaggcatcacgctacctgacttcaaactatactataagggtacagtaaccaaaacagcatggtactggtaacaaaacaaatgtgtagactaatggaacagaacagagtcctcagaaataatgccacacatctacaaccatctgatgtttggcaaatctgacaaaaacaagcaatggggaaaagattctctatttagtaaatggtgttgggaaaactgactagccatatgcagaaagctgaaactggaccccttccttacatcttatataaaaattaactcaagatggatgaaatacttacacctaagacctaaactataaaaatcctagaagaaaatgtacctgaatgtaccattcaggacataggcatgggcaaagacttcatgactaaaacaccaaaagcaatggcaacaaaagccaaaattgacaaattggatctaattaaattaaagagcttctgcacagcaaaagaaactatcatcagagtgaacagacaacctacagaatgggaggaaatttttgcactctatccatctgacaaagggctcgtatccaggattgaaaaagaacttaaacaaattgacaagaaaaaacaaacaaacaacttcatcaaagagtggccgaagtaatgaacagacatttctcaaaagaacacttttatgtagccaacaaacatatgaaaaaaagctgatcatcactggtcattagagaaatgcatcaaaaccacaatgagataccatctcatgccagttagaatggcgatcattaaaaagttaggaaacaggctgggcttggtggctcatgcctgtaatcccagcactttgggaggccgaggcaggcggatcatgaggtcaggagtttgataccagcttgaccaatatggtgaaaccctgtctctactaaaaatacaaaaattagccaggcatggtggcgcgcacctctagtcccagctactcaggaggctgaggcagaagaatcgcttgaacctggaaagcacaggttgcagtgagctgagatctcaccactgcactccagcctgggtgacagagcaagactccatcaaaaaaaaaaaaaaaaagaaaaaaaaagtcaggaaacaacagatgttggagaggatgtggagaaatcggaacacttttacagtgttggtgggagtgtaaattaatttaaccattgtggaagacagtgtggcaattcctcaaatatctagaactagaaataccatttgacccaacaatcccattacttatatatacccaaaggattataaatcattctgctataaagacacatgcacacgtatgtttattgcagcactgttcacaatgggaaagactgggatccagctcaaatgcccatcaatgatagactggataaagaaaacgtggcacatgtacaccatggaatactgtgcagccatagaaaaaggatgagttcatgtccttctcaggtacatggatgaagctggaaaccatcattctcagcaaactaacacaggaaccgaaaaccaaacatctcatattctcactcataagtgggagttgaactatgagaacacatggacacagggaggagaacatcacacaccagggcctgtcagtaggtgaggggctaggggagggatagcattaggagaaatacagatgatgggttgatggatgcaccaaaccactatggcatgtgtatacctatgtaacaaacctgcatattctgcccacgtatcccagaacttaaagtataataattaaaaaaactttaatttttaaactcctttgtcagcttacaatagcagccataaagaaactcagacaatgtgttccacttaccactctgcttcccttctaaatatcaagcagttggttgtaaactgagctgttagggcacttctgttgcaaagcacacttaaaaataaaaggaaaaatttggagaaaaattgttttaatataagaaaattttcaggcacctacaaagtcagggttgtggttagtgaagttgaggtaatttactgaaacttgtacaatgagtagactggaggattggaggaatctatggatttattttaagatatagagagcatttttttgttttgcagttattagattcattctgataaaataattttaccggaaaacaccaacaacttagttgcatgaaattttgtaatacatggggctatatgatccaaacttggctatctaaattatttttcccaggattttgagccttgaatgtagtcatgtaggatcgaaaaaatggttggagctgatttactgctgcagtgaagagacttcctgatttggattgaattgtgccccactcaaaaatatgttaaaatcctaaccatttatacctgtgaatgtgacctgatttggaaataagtaattgcaatcaagttaaaatgaggttatactgaattaggatgagccctaatccagtgtcactcgtgtccttttaatacgaagagtagaggcacagacccagacacagacagaagtccgtcatgcgaggttggaggcagagattgcatttatgctgccacaaaccaacagatgcctggtgctactagaatctagaagagggaggaaaagatcttctcctagaggttttggagaagttctgccaacaccttgatttgggactcctaggctttataactatgagaaaataaacatttgtggttttaagccactcagagtgtggtaatatgttatgttagctcaagaaaatttatacaccttccttttgcttcttctgctttcatctactgagatgctctatttctagttcctttccaatgctaattattttgtttttccttttttttgtttgagtcacactataatacttccaataaattccctttaaaattaagttgacccaaatagattgctgttgcttgcgtcattttgtcctagctgataagcaaatatttcttgctatcattcctgtgtcatttggtattggtagactagactcagtttgttagaaaaaatgaccaaaacttggaagtctggtgaagggagggttgcatatactcttagagccatattagatcacaaacattttttaataagcccacgaaaggagtgcttagttatctatagtataccattgtttgacttaatatttactataaagttccagcttgtgtgaacttacatgttaacttgtggatttttgtctagcagagatacaagtcattatttgcttgtagaaaaagtatcccaaaggttatgttagccatcttatgcctacatccttttttcactgtgtatataacccttattctaataattctcctttgaatcaccttttcattcctgttgaccacttcattaatgaggagagccagtgttataatatttgtataaaaatcatacttttaactatttgaatattattattgttattattgtttcttagggacagggtatcagtctgtcatccaggcctgaaagcagtgtcaccatcatagctcactgcagctttgaactcctggtcccaagtgatcctccgacctgggcctcccaaagctctgggattacaggcatgagccaccactctcggccaactatttgataattatactttgatatgtggcatgcgcagacaagattatttgagaacactgattgttccagattagctgaataactgtgagcacatccacaaggcagaatttaggatgttgacattaaattgaaaataaaagaggacttcagaatgctgagagaaaagtatgattttttcttcttaagattgaaaaaaataacatctattagtttaaataaaacctatccactcaacaaatattgatttagagactagtaattgtttcttaaatcgtaagacaacttttcactgaagatctggtcagagagttgggttaaatatcttcaaatcaaaactatttcatccagttcttcgggtgaaagcaaatcaggacacagaagcataggaatattacatatacattatattgatatataatatattatttattatataatatacataatatacaactgaattccaactgtaaattatagaaatttgataagaaaattagataatttcacatagtaagatcagactttagttttcattgcattattgaaacatgaatgaaatataacaaagaatgagtacaaccaaatctcttaacaaacttaatgtaggctcaagaaaacatttttgaaaaaagcccggtatctccccagtggaaagatagagttgtgtgtgtgtgtgtctatgtgtgtgtgtagtagtaaatttgggacaaaatgatgggtaggaaaggaaacacgaaggatactgccaccttctgagtgttttatggccacctctgcgaggagttcttaaaaaaaatcaagtatttaatacttactatatgaaaacatacattattgtcattaacacagataaagctaagagaggttaattttctttattagggttatgcaacagctgatgcagagccagaattcaaatttatttctaactccaatatttgtattttaggttttctattaaaggatattgcctctcaaaatgaaattgacattattggtggatattcagaattctggttgatttcacaagttgtaagttacaactatgacctttctgggatagcacatggtttgatgggaaaagtatagaacatttatttctagtaccgcattgccctgaaaacaccatgtgacctttggaatgtcactttttgctttttaggcctcagttaccaaatctataaaatgagtttatcagaccaaatgaatagactcataactgtggttcatagtattggttttgcggtaaagtagttcaaccgtatttcattcaaaagacatttattggagtgtataatgtaaataaatctgagatgcccttatttggaagatggcaattactttctgtacccctaagaaagaatgaaaatttattacttaaactctgacataatgccttattattggtgttttatttcataccttgtaaggaaaacttttaaagccttatttagaaatagatatttttactatatatcacctgttcctttacaaatagaaaagtaccagaaaaataaatttggttaaggttttcttaaaacatctttcccatttagagttcaatttttctggataacttttagactcaacttttacgtatttctccacacattagcatcttctaatgcttcacaactgttggtaataaagcattacttaaatgaatgttgtattatgtccttgaggttttcttagaagccagtgatatattgtactcaagttttgatgctgggagatatgtaagtatgcatacacacttatgtgtttataaatgtgagttgtgggtatatatgttctatatttccacattatgagcaactaagggagaacacttggatatcgttcacgttgatgtttcttccaacactcactacattattattcacataaaaagaactaggaaaattttgatggcagaaaatagagctaaaatatcttattcttattttacaagtttctaactatttggtttcatgtgtaaaaataagccacattaactagggtgaattttctatatctactgaaaatgtatttctaaatgtttaccatatattaacaataaaaacaattaggatagtaaatggcaaacagtatcagtgaaggaaaatttttccttagaaaagatcatttaaaactacattatttcatgaagttctgctgtgttatttgttgatatctgactaattaaatgcaaattatcaaggaaccatctgccaggctcattcccagcgatcaattgggtaaataaaggtaacaaaacggtgtgtttggttttgcatctaacacagtatttgttttattaccatcattttaaagctggatttttattgccattttatgtgccttgtaatttgtacattaaaaataagggtttcaaaaataatgatcattttgcatttaattcaacagaaatgaagtgcataaaagcttgttttgattgaatactgaatcagattccaaaattctaagtgtcccaacacaggccagtctccccaaacactcatgtaataattctgagttacattggaaataatttgcttaaccatgtcaagcacatgagcttgtgtgttctagaacaagttgtcccaaatggctatacttcagcgtatcaaaaaaatcatttctctcaacttactggtttataacatggaaagcagagtcagccttctacctggtgtacctgctattattaattactttgtccaattctaggaatttcgcaatgagtcctctgacgtgaatgctatttttgacacacacacacacacacacacacacagagagagagagagagagaaagagagagagagaaagagagagagagaatattttaaagggatggtataacataagaacccaatggagagcataatgtaacatgaggttataagagcagactctggagcgaatttctgagttcaaatcgtgtctcaaccatttactagctttttgaccttaggaaagttacttaacttctcttgtcctcagttttcttatctgtaaaatgggttaattaatagtacctaacgtataggagtgcttcaagagaaaactaatatttataaagcacttagaattctacctgctacatattaaataccatattatttgtgtaatttaaaatatataacatatatttattaattgagttatgttttcttactattgatttgtttctaatatgttttagatattaaccccttctcagatgtttagtttgcaaatcttttcttccattctattgtttgtctcttcattctgttgactctttcttttgccatgcagaagcttattagtttgatgtaatttcatttgtctgttttttttttttttggtgaagacctgtaggtcacaaatggccgaaaagtatataaaaaatgctcaacatcactaattatctgatactttaaagttaaaaccaaagtaaaatattccctcacacctgttagaatggctattataaaaagatgatatttaataagtattggtaaagatgtggagaaaatggacgaattgtacactgtttgtgggaatgtaaattaatacagctattatgaaaaacagtatggaaatgcctcagaaagtgaaaactggaacttccaagtgatctggtaatcctactactgggtatccaaagaaaatgaaatcagtatgtcaaataagatatctgctcccctacgttcattgcagcattattcacaatagacaagatatggaatcaatctaagtggccatcaatgtatacatgaataaagaaaatatggtgtatatacatgataaaatactatttagcctgaaaagttgtgaatcctatcatgtgtgacggcatgacataacatggaatacattatgttaactgaaataagtcaggcactgacaaacaaatacaacatgatcccacttaaatgtgaaatctaaaaaagttgaactcttagaaacaaaatataatggtggttaccagaagcttacgtggatggggttcaaggagatattggtcagaggacatgatattttagttagactggagaaataagttcaagagatatgctatacaatatcatgattacagttaataaccatgtattatatgcttgaaaattgccttgggtgtacattttcagtgttctccccacacacacaaaaaatatgtgaagtaatgcatatgttaattagcataatttagccattccacaatgtatacatatttcaaaacattatgttgtacaccataggcaatttttacctgtcattaatgataactcacacacacacacacacacacgtgctcacacacatgcatttctatgagaagtcccatcacttgctggaagattttgcagatccctgatgaatatgtgacagaatatctacctgttttattctctattttcttctcttacctcctataaataaacctttttgctatgactcaaaaactttattacaatgcataaatgtgtatataatgtccattagctgattaattcaatgaaacctaaatctagccatacacacattgaaagtcaaactcactgagaacaagtagaattgagtggatatcaccaagtttcagtaggaagccagtcttacctaaactgtctccctcagatattcctattgagaagtttctgaggaaggctacagtaatgaaagtattcacaaagtcctaaaatgttgccagtaatcagtcagcatagtgaccactgatccagctcaaactcagttatcttcactagctaaatcctgttacatggcttaacaaggagcactgactttgaatctgggtcataaagggaattcacagtgaacttttacaaatgttgcagactcagcaggatccaaataaagaaagtcatagattatgtctctccctttgaattggaaaattggtacaattttccgtattgcctaagtatcctgatacttgctttcttttacgaatagaattgatttccaatgcaatttcatccacctttgtttcttttatcatacgttaaacatggataagagtctcttaagagtgtacacatttttagaatggaaagacaattcagtacttaataggtgaggctactgggtgtcttctcattgacctcagagtgtctcattagttcccattagtctccagcctcattaaagtaatggatataatgcaaatagatttcacggaacagctctgcaaaagttcaattgtcccattttactattggtgtatttacatattaagttacacattaacctgtatagtagtgtgtgttttccacactgtataccttggagtattagttctgtgtaatatgaagaagtgttatgaggaaaaaatgcagtcacatttgtttgaaaaactgagttcaatcaagagatacaggtttttttttttctattgttattgttgtttttactgttggacttctcaaaaccatgttaatatgcatggtcagtcttcaatgaagagatgcagtaagccgtattcccaatgttttgaccactttttttttttttttaacttagacgatttctcagaactggtgttctcttgtacacagtttgggaatgactgcttggtacacttgttgttatttctgaaaattgatattaaaataataatttatgtactaccacttgaattcttttatcagttaatccttcttccttcttgcagatagtggagggctaagaaaagcaggaagtcatgaatgattgagaaacaaataaatgccacttatctcattcctcccctgggaaaaaagaacagctttgaaatttactgtatctgtcaccaatggagaaattgatagtattgagtatatttaaaagaaaagctattagcaagatcagttaggactgcctgagtgaatttccaactgttttccccatactaatgctaagccattgctagaattccttctatgtggcagtgaaaacgtaaaatgatgtcttcccattacaaatcaaatgaggacaagtgagtagttattgtaggaagccagcttcgggattaatatgagggaaagtttgcaaacatagaagaacggacattgttaaaagatgtaacagagtagattaaatgctatgactgtatgatccaaaaccaggcaaccatatccatggctataaaatattccaattggaagggaacttaggataatagtggatggatttcagcttttataccaagtccaatcaattgtagaagctttctgagtgctatgttgagggaaatccatatctcagtgggaatgaatagcatgatcaattagcaaaagatcctatttttaggaattggagatttggcagcatagggatcacctacttgccattcttgatttagttcaattgtgcattttgcaagtcggctgttgtgatgcacagaagctgtgtaacttactcaaagttatagcactagctaaggttagagccaaaatttgagccaggtgtttgcatcccgagtctttttcaaaaataggctttgctcccaggcgcggcagctcacgcctgtaatcccagcacttcgggaggccgcggtgggcagatcacaaggtcaagagatcgagaccatcctggccaacatggtgaaaccccgtctctactaacaatacaaaacttacctgggcgtggtggcacttgcctgtagtcccagctacttgggaggctgaggcaggagaatcgcttgaacctgggaggtggaggttgcagtgagccaagatggtgccactgcactccggcctggtgacatagggagcctccgtctcaaaaaaaaaaaaaaaaaaaaaaggctttgctcaatatttttctcaaaacagctatcattgccctctttgccatttaaaattttaaagaagacattcaatgatacaacactaacattcactcatcacattagggctgttgagaatgtcttcttggaaccaaagcagtcagtcacacaacacatatggagctgtaggctgaataaaactgcaagagtcattctgacttgcagagcaagccagggtggaaattggacatgttattatatttgataaagaaggcaatgttgaaagacagagaaatgtccttgtgtagcaaaaaaaaatttgaaatatcatatttttgcttttgccttagtgctgtctttaaaattttagactcttgactaaacaattaaaaatgaacttgataccccttatagcagctgtgcatacacaacaggagctactcagaaatatgccttagaaagctttctttgaagtgtttctttaccactttctttttctttgggttcaaattaaatagaatatcagccgtccacttatcttaatgacaattattgtgaattagacactgagtagaatacagtgacaaagaattgtaggcttttgccaaatggagtggaaaacagtaggaaaatatgatattctggccgggcgtggtggctcacacctgtaatcccagcactttgggaggccaacgtgggcggatcacgaggtcaggagatagagaccatcctggctaacagggtgaaaccccgtctccactaaaaaatacaaaaaattagccaggcacggtggcgggggcctgtagtcctagctaatcgggaggctgaggcaggagaatgtcgtgaacccgggaggcggagcttgcagtgagccaagatcacgccactgcactccagcctgggtgacagagcgagactctgtctcaaaaaaaaaaaaaaaaaaagaaaagaaaagaaaagaaaacatgatgttccaagagcgaggagacatcttatatatacaaatatagtgctcagtaaacattaatacaatgtgagttttctaattaataattatgccttttccagattgtccaagtcactagaagcctgaattttcacaatgactgctattgtcttttgtcatggaatcgaaaccttagttttaatctcattaactccctggcccagtcttctactaataggataaaataaagcatggttaaaagaaaaaaagcggacagaaatatctcacatatagaatacataaggccttatccataacattagagaaatttagagctacaatggactatttaaagactaatttaaacttttccaaataagtaaattgacaccgcagaagttatagggacttgtgctaagcgcttggttcagtgtgctgaagataaagctgaaacttagtgttctttccatttacccaataggatgacctaaaatgataaaatcataaaatggtgtaaacaaattccatcctcatagggcatctgcactggcaataatttggaagatcaaaatcacattttcttcttcattattctacaaggaatgtgaactgacaaaatgtgaaaactttttagaatataggctttctattacaattgctgaaatagttgaacattcaggttgttaatttttgaagacacagctatttccaaactgtttttatttttgttatgttttatcacttagttttttacacatcatgaagattaaggtctttgtaatttaaaaattatgcaacagctgctgaaaactgcctcttacactggaacatgaaatttatattaggaaaatacctattacttgctataaaatatgtatgaggctctgtagccaactttgtaaaatggaatttctcctcaaagcaaaatggaatggttactttgcttgggggatccactgttaaaggagtatggtattgatatgtgttaagtattgttctatgacatgaataaagaatacaaccatacattgtgatactcagtattgtggaattatttctacaccattttattatttagatacttatacactgacttttgcagctgggcttgtttttacggcataattgtttagatacagacgacaaaatgtatatttataattaatttggttctgtgtgcttctacaaataccacacccacaactactgtcaacaagaaaaaaattagaatatttagggtatttgatttttatgacacatgacaaaaagttggctgttgtcggtgatttaccttaaaaagttgtttcttagagcatttcacaaagatagaaaaaaaattgttttaattacactttgtcccagttcttaactgtataagatgcagagggtttttattactatatttgaaaccaagactcaggatggttaaagaacctgaccagcttctttccatttcttcacaaaacaagcaaatcaatctttctaaaatatgtatcttaaaatgtcatcgatacactgtaaaattttcatttcttattgccagctgaatggaggtcaagtaattaagctcactttcatatttaaagtcttcttcctcagagagacctcaaaaactttgcagctctttctaactctgtttctgtagatcgacctcacactccacacccccagctagacatttatttttgtcttatcttttcttctttgtttgcccaggaaagaataaccttgttcatcatcatcttttacagttattctcatcatttcaagggcatctcaaatgttttgattcttcaacagtctggttcattctcatcatatgtgactagatatgtttttggagtgtggtagtggtgggtagcatgctcctgataatctctcttcattcctgaattccagtacaaggtactggtcaacatatcagaggtggagtcccactgcctgggtctaaatcccaaatctgcgtttgattagctgtgtgatttagggtaagttattttacctctttgtgcctcagtttcctgaagttgataaaggggatactaacagtagctattttacatattttaaagatatgtaattgtagtgcgctgcccacagtcgatgatcagttaatgttagttattatggtggaagaataaaattaatacttattatataatcataatgatctagcatgcttcacctcctggctgcttttaagaaataagatacccttatatgtgtgtcgctaagcagaatttatacattcttttcattcctatagattgaaactactattttaaatttaaatttagtactttaaataagtaccatcacatgccttaagtcacaatacttaaaatcatagccaaattattgatctcatatacaaaagtgagaaagactttctcacttctgtctacatttaatctgcatcattttcctttcattatatgcttagaagactatgtcagtaatgcctcctgtttggagaatttccagcaatatattaaggagttcatgcaaaaatttacagaaatatttaccatttagtgatatactttcagttttaaaataaaacattgtgttgatggaaaggcttgacgacttcttagaaaacaggatgtgctatttatcaaattccatttaagtttagctatttggtaatggattatggattctgaatgatgcaaggagttatattcttcactggtagaaagtcattgggtcaatatatttaccgtaaagcaggtaatagatgtcctttattatctataactatgccagtttgtctctcgttctcatcaagtgtaagcagtatcattgggcaggattctgatatgactttatgatttaggaaatcagtaataacacaattaaaattacatcacacacaacacgaaaaaattatgcatcactttgtttataatgtttctaaaaaacttccgagtttgggttaattgaaaaaggtatttaataaaggggtgtcaaatttgcaaaatgttctcaccacttaattggtggaaggttcatataactactgattattaggtaaaatgtatagtaaatctaaaaacataaacacagcattatgcatttaattcaacttttattgttgtcagaatatgtgccagaaatattccaatccattaacaaggttccaaaatatctccagctggctgaatagtggggtcattcaaacccctaaaaagttactacatactcctgtctgttttggccttcttattatgttttttccttttattatactttgtgcagagcttaatttctgctctattggacttaaattgttgcactaactttaaatatgtgctaattttatcagaaactagatgtaaggtgattttagcagagaaacgtagcttgttaataaaattcgtaccaattctggagtacaagtttgatcctcttaaaataacaagcagtttgtgtggaatattgaagtatattttatcatcagcgaagttaataactctgcttagtttgatattttctgtgtatatatacatttttatagctttaccaaaacagagcttacactagaccgtggtttctttttcctccttccaattactatgtgttcttaaatgtgacaaaaatacctttgctttttgagttcagtaattaagaggtttaactacttcaagctgacctccctgcaacgagtgcaaattagtgagattaaaatgagattgcttctctgtgttctctcggtttacatgcaagttttaccacacctcattagttagatagttcattgcagcgaagtgctatcttgtacgttttcagagaaaacctggcttgatcaattagtcttggtaggtctttctgatctcttaaaaataattttgaaataaaactggcatgtgtgaaaattatccattgatattttattaaatttctactacatgtacgtactttaactcagtcattaactctttctttttaaatattatttaagaataaagaagaaacttgtttaaaatatggtgtcacagtcagagtacactgatttatgctacaatttccaagatctcagtggtttgaaactcttaaaatttttctttttctttctcaagcttcatgtacaacaaagggtggcaaggtagtctgttctcatggtagttactcaaggactcaagagaaaactctttatcttacataattgctacagttggaaaaaaagattcatggttaatcaatactggctttgataattccacctaaaaattgatacatgtaacttctgctcccattacagtggccaaagccatgcctaatttcaaaggggctagtcaaacatacttctactatgtgtttgaaaaacaaacaaacaaaaacctacgatttttctcattgatcaccaaataaacaatacgcctttctggccatcatatatttgatatactctctttttctcctaaataaatgtacacactcacacacacacgcgcgtgcgcacacacatacacactgacacaggcacacaccactgccaccgccaccaccaccaccaccaccatcaccctgaataacaacacttcctggtcaataaaggaaataactcaccaataatacccagccacaatattaagattaatgtcttatttatctcagagttttagctatgattatagcataaaagttagaaatcattccagaaaagggtgcagtaagaatatttccaaaggtttgggtgcattgtataattaatgcaaccctgtacaaactatgtttacagtaaattaaatctagaaataatatgaagaactatgtacaatggccaactaagatttattccagttaagcaaaactggaaaaatcaatcaatataatcttgaaaaatatgatcacttgaaaaatcaaccagtataatctctcatatctataggttgaagaataacttatacagaataaatcatttgacaaaatataattcatttataataaacactttcagtaaagtaggaataaatggaaatttcttctacttaataaagtgcagctacaaaaaaacctaaaactaacgttatagttaatcatgaaagagtaaatgctttcagctcaagattgggaacaaggaaaggattgctcactctccacattcttattgaatatagtaatagaaagtctacccactgtaataagaaaataaagaaaatgtgtacagattgcaaaggaagagataaacctttcgcgatttatagatgacatgactgtccaagtagatcctgaggaaactatataaaataaactcctaaaactattgtgtaaattcagcaaggttgcaagacacaaggttaacacataaaagttaattacatttctgcatgctaacaataagcatgtggagactgaaatgaaaaacacattaccatttataactgatacaaaaatgaaatgcttaaatatgagtctaacagaatacctaaaaaatttataaactaaaaattacaaaattataatgaagaaattaaagacacaacaaataaatggagagatataccatgttgatggattggatgactcaacatgcaaagatccccatcttgccaagttgattgaactatttggacacttgtctattttcttcctttttttctttttttgagacaggatcttgctctgtcacccaggctggagttcagtggcacagtcatagctcactgcagcctccatctcctgggatcatgcaattctctcgcctcagcctcccgagtagctagaataacaggagcatgccacgatgcccggctaagtactttatttttattttcttgtaaagatggagtcttactttgttgtccaggttggtctcaaaatcctgggctcaagtgatcctcctacctcggcctccaaagtgctggcattacaggtatgggccaccacgcccagcccatttgtctattttcagtaaagcctgtatgtatcagtgagatttggtataatttctattaaaatcctagcacggtttttttttggaagcaaagacaaacttacaatgaaatgtatgtggaagttacagggcataaaatatttaagccaatctccaaaaatttaagtggcatgaattactttatctgataataaacctggtatatagctataaaacatcaggtaatgtggtagtggccaaggcataatatagattaacatagatcaattaactgttaataattaattaataatatatattaattaataattaataatatagattatataatttgattaatataaattaatatatattaatagaacccataattagacccacttaatgatgtctttttttgacaaagatgccaaagcaattcaatggctaaaagatagccttcccaacacatagtgatagagaaattggatataggcaataaaaattgaaccttaacctcacctcatactttgtgcaaaaattaactcagttggattacagactcaaatataaaaggttaaattataaaacttaaaaaaaacacataagaaaaattttcagttctagacgtaggtaaaacgatcttagactgacatcaaaacatagcccatagaggaataattcataaattggaccacataaaaattaaaaacttgtgctctgtgaaagcacaggttttcatcctgttaaaaggatgaaaaaataagccaattagaaaaaggcaaaagatataaagaggcatttcacagaagataatgtacaggtaaatcatagatacaaacaattttcaacaccagtagtcattggatagaaacagactaaaaacacagtgaggtatcaatacacaccttctaaactgagtaatctttttaaaagtaacaaagccagatgaagatgaggatggagaaaagttggatcatctctacattgctttttggagtgtaaaatattacagcaactatgggaaaataattcagtagtttttaaatgaaatttatatgcaattataatgcagtctagcaaatacacgcttaggcatttatgctagagaaaggaaaatgtatattgacacaaaagtctatacacaaatgttaatatcagctatagtaataatagactcaaactggaaataatccagatgaccttcaattggtaaatgactaaacaaaccattgtttatccatactatggaagagtacttagtaataagaataagcacagatacaaggaacaacttgtgtgaatcaccaaggaattacgctgagtgagaaaaaacagggcaacccccaaagcttatgtaccatataaagctatttaaattatactttaagaaagataaaattttagatctggagaagagattagtaattgccaggtattaggagagaagaaatagccagagagagggtggtggagacggttacatagggcagtataaggtgtccttgtggtgatggaactgctctgtgttctgactgtgatagtagatacaagaacctacatacatgacaaaatttatgtaaaatatatacatacagacaaatacatatacacacaaagtagaaataaaactgaagagatataaataaaattgatggagtgcgtgaatgtcaaaatcctgtttgcaatattgtactatgaagtaacattagggggaaccgagtaacaggtatatgggatctctttgtaatatttcttatggttgcatgtgactctacaattatctcaaaataaaaacgctaattaaaattaattttattcatagatgatattatatatagaaaaccactagagactttatcaaaatacagttagaactaattatcaaattcagcaaaattgcaggatacaaaatgaacatgcaaaaatcagtagcattttgttgttgttgttgttgtttgttttgagatggagtctcactctgtcaccaggctggagtgcagtggcgctatcttggcttactgcaaccttcgccttccaggttcaagcaattttccaggttcaagtgaatcttctgcctcagcctcccgagtagctgggattagaggtgtgcaccaccacacccagctaatttttgtatttttagtagaaacaagatttcacgatgttggccaggagggtcttgatctttgacctcatgatccacctgcctcagcctctgaaagtgctgggattacaggcatgagacactgcacccagtctcagtagcatttttatacactatttatgaactgtctgaaaaaaaaaatcaagaaaatagtcttatttacaatagcattaaaaatgtatatttaggaatagatttaaccaaagaggtgaaagaacgttacactgaaaactatgaaacattgctgaaagacaataaaaaagacaaatttaatggaaatacatccgtattcagggataggaagattaatattgttactatgttcatactacccaatgtgacctacagattcaatgcaatctgtatcaaaattccaataactttttatagacattgaaaagatgacctaaaattcatatagaaccataaaagatctgggataaccaaagcaatctggagcaaagggagcaaagctggaagtattacactacctgatctcaaaatgtactacaaagccatagtaatcaaaacagcatggtactgacacaaaaagagaaagagagactggtgaaacaaaaaggagagactagaaataaatttgcacatttatagccaactgatctttgacaaagtcaacaggatcacacaccagggaaaggagtctcttcaatgagtggctttggaaacctgggtatccacatgcagaataataaaattggaatctatctcaccccatctacaaaaatcaaccaaaatgaatgaaagaattacattcaggaccttaaactacaaaactgcaagaagacaacagagaaaaaagcttcttgccattggtgctatggtttgtagatgatttgttcctccgcagcaaaactcatgttgaaatttgatccctaatgtggaagtgttgggagggaccctagcggaaggtgtttgggtcatatgggtggatccatccctatggatggcttggtgccgttctctcaatcctgagtgaggtcttacaagactggattggttttcaggaaatagatcagttcctatgagagttggttgttataaagcccggatgcccctagggtttttgcctcttcatatgtgtccacttcccctttgaatttctcccccgcgacatggcacagtacaaaaggtctcaccagaagctgaacagatgctggtatcatgcttcttgtatttccaagcctgctgtattgtaagctaaataaacatattttctttataaatttcccaatctcaggtattctgttatagtaacactaaatgaactaaggcaattagttcaggtaatcattttttggatatgattcaagaagcacaggcaacaaaagcaaaaagggacaaatgtgattatctcaaactaagaagatgatgcacagataaggaaacaatcaacagactgaagagacaagttacggaatgggagaaaacattttataaccatgtatctaataaggacttaatatccaaaatgtggcaggaatacaaacaactcaatagcaaggaaacaacccaattaaaacatgggcaaaggatgtaaaaagacatttctcaaaaaaaaagtactaatggtcaacagttatattaaacaatgctcaacataactattcatcagataaatgcaaataaaactcacaattagatatcacctcccacttgttgagatggctgttatcatgaagacaacagataagtaagtgttcgtgtggatgtagagacagggaacccttgtgtgctattgctgggaatgtaaattagttcaaccattatggaaaagagtatggaggttcctcagaaaactagaaatagaactaccatatgatccagcaatctcatttctgggaacatatccagaggaaatgaaatcagtatgttgaatagatagctgcaccacaatattcattacagcattattcacaaaacctaagatatagaatcaaactaagtattcatcaatgaaagaatggataaggaaaatgcggtatacacagtagaatacagttcagccttaagaaagaagaaaatcctggtgatttgtgacaacatggataaactgtgaaataagccaggcacagacaaacaaatacctcatcatctcatttgtaactagaatctaaaacagccaaactcagagaaatagagaacaaaatgctggtcaccaggggtttggggacagtaggggttgaggagatgttggtcaaaagcatacgaaattttactgagacaggaagagcaggttgaggagatctactgtgcaacatggtgactacagttaataaccacataatgtatacttgaacattagtaagatagtcgattttaagtgttcttatcacaagaaaaaagtatgtgagtttgagggaacaaatacgttaattagcttgacttagccaatccacagtgtatccatatagcaaaacattatgtcgcataccataagtatgtataccctttgtcaattaaaaaataaaatatttaaaaattaatttggcaatatatcacagaggttttttttttaataacaaacataacttgaatttccactttgggaaattgacttaaaaacaaattactgaatattgcctagttgtagggaagtcttattacacataaacacacaaaatgctgatgtagatctgtatcagtagacatttggaagtaacttccaagtaaactaattgataaatagcaagtctcaaacatatgcatagttagacctcatttatataaaacaaaaacaagttctgtggatctagtctgtgtctgtgagtgtgtagctagatggaaacactccaaattattattggttctttccagtaagtacaatatggggtactgtaaagaaacaggaagtttattttatattcaatgtaattatcattgagattcttataatatacatgtgtaactttggtaattaaaatattttccttaaaagaaggatatgtgtgctcataaggaataatgtttattatgtaactgaataagacagtacgtgtttgttcattaagtgtggtgtactatatattaactccttcaatatttagggaataccttttattcattcttgaacacttagtgcttagtacagatgaagggatcaataaatatacagattatgcttatatgaagaaaaggagactaagaaaattcaggagaatataaatttttttaaattatgtttatgggtgattttcttatttgttttaattttgactgcgcaagatgttaaaacttctatgatgaaaaaaacagtagtcaaactagctcgtggtgatcccagttaccaaagtatgcaagaaatatccagtcactttatcattagttttattttaaataaatcatcatacatatcctcatgtatatatcacacagtgaggattatcgtattcaaaggacacactggaaatctagtaatattaaacttggctttgcctggagtatagattggacagcagacaaaaatctacatgttaaatcatagtcctctaaatgacgtttctgttgttcgacatgtcatggcacttcgctttaacagtctctcatttaacttgcttcttcaacatatgtgctcatcttaatcattcactcatccttgaagtagccaaatttaaatgtcatgtgtttttattcacagagcatggaatcaatctcattatacccttgaatgcacagctttcactaggagaccctccttctaagccaaaaaatcaatttatgtttaactggaggaatgatatctttttctgattgttggcaaaatgagagagggagggagagggggaactactccatttattatatgttaaaatgtcacttcatggttacctcccatgtgcatggtagatctggcagctaattaacattgtcaaaccacgttaatctcacctacaaattcatttattattttggataatgtaactgaagttgtacaagagaagattcaggatcacattaaatgcattgaactattaatgtattagaacgtagtatgatcaagcagtagctcagtactcattacgatcctcagtaaattcttcatcatacaattgggaagagttgctttgtaattattaactcagaagacaatacttctataagatcatggactagtgtgataggaattattcagggaacattttgaacatgaagcttctcttcgtagcttcatagtaagtttatattcagtttgctgttctccattgttagtatgctaaggttcacaaaagaattatctctgagatgtctcttgcatgattgtactgtaggtcagagagaatttgagaaagtccagtgtttcagataacaatttaagatacaaacgtgttagtacagatctttatggcttaacaaatcacttttacatggttttagctgatcctagcaaaagtctcataagtaagcagatattactaactctaaaaggttaaataacttgatcaagagtacactgtgggtaaaggacaaagttgagatgataattctgcttattgatggaatgaatacatgcataataaatgaatggatggcaaaatagacaactccaggtattcttacagatagtacatcattgcagctactcacttataaggcatataccatatgcattaatattgcatgttcacccaaaactttcagttaatctttatgcattttggaggtaatgtcttaaaaaagtgatgtgaacaagccccaataaaattattgttttttgctaatgaataataggatgcatcagtttagacagaaaatagattctagtaatttacacagcttaaaactttcagatttgtctctagctgataaaaatcagcggcatctggtagtacaggaagggggcagtagaaattctatgctgtcagggctacaccatcagtgtgagtagtgattttaccagatgatatgaaacaatattcttgttatcattgtggagcctccaatacataaaaatacaaagaaaaggggaataacgattcttaaaatattttttaatcaagcagcacaaatttgaaatttgccatattcattcacttcctgaattgaatatcatccatatgaattatgtatcacattgatgtcatttttatgaactgctacattggtgactaattgaggtatattttagttttaaagaatatgttgctgtgcttaattatcctgataaacacattttataacttctagcacatatgctatttcattaaattaatggttttcagaatcattgatttaattgacagtttgcaattcatgaagaaattggatgaataagtgaatgtacattttatattttacaaattgcagaatacaagttcatgagtctttttcacttatgactttcattagttaatggtatttccatcagttttattggacacatgtcatgacagtaggaaacaataggattgtctgcatcaagaaagaacaagtagtaagtcatgaatcttttttttctctgttgtaagcaaagcttaagcacagatattgctaatcaaggtttggtcttgttcaagttccaagctatcatcaactcatcgtaactattgcaaaagtctcctagttggaatatctgcatccactttgcctagtctcaaattccatcttcagtctgtagccagaagaatatctttctaaaatcaattaaattggcatctattttattccttaaaactgctcaatggctccaaatttctcttaggatagtcacattagttagaaaaaagtagcttccataacaaaaaaaactacattttattggcataacacaaaagattctctttcattcacccaacggtacaaaatatatttctggtatgtgagatgcagcctaattatgacacaagaaccaatgttctgtcgcttaatgacacagagttctctgcattctgataaaagaagttaaaaagaatgaaggagtcacataaaatcttaaacatgttattccagatgtgcacatcatttattttactttcaatttttatggatacataatagttgcacatacacgtggaataaatgtaatattttgatataagcatacaatgtgtaatgatcaaatcagggtgattggtggatccaacacttcggacatttatcatttctttgtgctgtgaacattccaaatccactcttctggttattttggaatatacaatagattattgttaactatatcccctctattttgctactgaacacaagatcttattcgtactatccaactgtgtttttgtacccactagcccactcctctttaaacatgtcccactattctcagtttcgggtaacattctactccccacctccatgagatcaattattttagctctcacatatgagaacatgtgatatttgtctctgagcctggattatttctcttaacagaatgtccttcagttctatccatgttgttgcaaattacagcgtttcattcaggtggctgaataatattgcgttgtgcatatgtaccacattttctttatccattcatctgttgatagacactaaggatgatttcattatcttggctattgtgaatattgctgtaataaacatgggaatgcaaataacttttcaatatgctgatttcccttcttgtggatatatacccagcagtgggatttctggatcatatgatagttctgcttgtagttttgaggaacctccatactcttttctatagtggtttaatactctggattggccagaatcagcctgatagccatatatatctgcatttatgtctggagatattttccttcaaatggtagtcacttctcaggaaaattttccactgtaaatggtggcacacggtttttagtaaacagttaattgtctctgctgcaaacctacctcttaagatgtcaggtaagacctgcatttctggccatatcaagcacactgctcttcttcagctgatacaagtgttccttctatctcttgagtgccatatgtttccttctaaaatatagtttttcacatacttttatgttttgcctactattctattcttccttctggtctcagtaaattgtgatttccttataaaattcttacccagcttatgtgagtcagttttctgtgttacgtattctcatagtcacatcctacatgcacctgtattctgcagcacttgtttctgttgcaatttttacatttgtttattacatgaagccttcaatacagtattagctttatgatggtggatgtttgcttttgctcatcattttatttttagcctattatgaagtgcttagccacagtaggcactcagaagtactgcataaataaatgaatcaattgcctgatcttgcactcttcaaagccttttacattgctataattgtcttccaaatgcaaatgttcatcaaaggtgttttttctccattttgaaaaaaaatgaatgctttagtttgggctccctcagaagcaaactctaattttaatattcaagtgtaagtattttatttttgttcctaggcatgggaaacgagagaaatgggaaagtggtacaggaaggaataggcagccaacaatgtgataataaaccacatttgctgactgaataattccatagtgaagactgggaaacaatgtaaaacactacatcagaaatattccacttgatggaaaatggacttggagtaaaaatactccttgacatcatcattaagttacaactcatgtggaggactgctaattttccttagagatttagcaagcgaagtgaccttctggggaaatattctggaccaggagatgcagattttggtagctggaagactgttgttcatccaaaaagaatatgtataagggatgtgggtattcacagcatccaacacagttcacccgaggcttagtgccactgtcatcacacactgcaagcctttctctctctcacgtttgactcttcctcttttggctggtcttcactttgtgctctttcccagtcttcctgaaaggacactgacagatgagtattcttaaagcacatcatctctcctgttatgtgccttctccacagtcctcagtgagtattcttttactctaagattcagcctaatccttagcttacattcaataatgtgtaaaagttagtctattcatgctttttttcactcttgacattcactgtcaaattctctcctttggtatttacttgtgcttttctacataacttcctacaccccttctacctgggataatcttgtcttgttgaattcccatttattcatcaatgcagagtttaaatctaggcttttaaaattttactttaattgaaaaataataattgtacatattcatagggtacataatgatatttctgtatatatacaatatatagtgatctgattggaataattaccatatccatcatctcaaaagtttatcatttctttgtgtgggaacattcaatattctccctctagctatttaaagctatataatatattaatgttaactattgtcatcctacagtggtatagaacactagaacttattcctcctatctagctgcaattttgtatcctctaacacatttaaatctaagcttctttattggaatattgaatctcacagctgctcaaatgacttaccttaacaggtgaagtatttgccactcctgtatgttgttatgtgtgagtttggcaaaaatgtagtagagtaacccagatgagactgaatgagtagtgtcatgtatatagacctgcaaatgcctccttattctgtaatttgatgaactcatttctaatcggtcccaccactattgataattttgtaaaatgcctatgacatgcatggttttaactatgctttaggacctaatcaaaggtattttttattctataacaattgtcatacgtcaatgtctcatattccctactagattataaattctaagagggaagagatgtgctgtaattcaatctgtatatcagagtgtctgtattttccttgtgataagcactgaaattatctagaatgagtcaatagatttttcagcaaccttcaggaagtttcatgttcctttctttatcctaaccatcacctatcatgtactgattatgtcatgaccctagccccactgaccctaagcttaggcactgcggtgattcacaggcctactcttaaagtgaatagcttctttagaaaataaagtataaaaacctctttgattatcttatttctagaaatcatgttaggaggtttgatgttgatgaataaataatgtatgcttactttggactgattatgcaggtgaaccaaaaaggttatatttatgtgcgaggaattttgagggagttttgcagtcctcaagccatgctcattatctgataattgtccctgtttcaactgtgaatatcctgtggacatgtttgtattatgtgtttctatccattccagtgttcacttattgaataggggatatatatttgcaaaacagacaaaaatcatgtaatatttctgctgtcaatatactatgctgcatgcaaaaatgagtttcagttatactgagagacatacaatagaaaaaccgaatatatttttattgagtggaaactcacttcttaacacttcctcttttgatctttgaaatattctttattttttagttcatatacaaatttaaatttttcttctcatccttttgagtatgcactcacccacataccacctctccataattttatcctgcttcttagttcattagttaagattaactgtctcagtggtaaattacatataccactttaacaatgagaaaatatatcccaaaattttcttgtatagagtccacttatttctaattttattcacaaagcacgtgctttattcgtgagttctattaccaccattactaacatcctacacacaaggaaaaaaaaaggcgaaccaaagagcaaaaatattacttaatatgaacacgggctccttccagatctggttcaatagcagttcttctaggtaaggcatagcttagaatcttaaaagtcaaagtttggcccttggattatcagtattgacaccaattagaagcttgttaaaagcataacctctgacactatctcagacctattaaatgacagcctgcatttgaatacaatctttaagtgccgttttttgctgttgttcttgcaaattttgaacctgtgggacccagaaatcacaatagcaaagatggctagatatctaccaaaaagtgtcctctttttgtttaataatagaacttcctaattttagctggttaccaggttacccatcaaaaaatgcacaacctagttttgcttgcactttggcatagccaagggactaaattctgaccagaggcatgtgagtgtactgaagtctaggatttccaggtcacacctagaaagtaaatgtatttgaactttctaggtccttttcccacttgatgctgtctcgtagatggtaaaaatttgagcagcaaaattggacccagaaaagggaggcagatgttaaagatggacaaactattttgaactgttctgtgagaaagaagaaaactttcatcttgtttaagcagctaaaactttttcatgtcttttttattgcaattacatggctaatatatttataagttaactgtgtctccatcactctattttaaccatgtctacagtaacacaaaataaggcacagtgaattatatgtataacctcccctcattgatgttttcaacagctggatcattgcactacaatccagtgattaattcaagtcaatggccatttttgtctcttttgcaacttccaaattcatacggtttagtagcttttgaattaaaaatatgtcactctttctaatgggtaaaataataaaaatagtaccagaaaaagccacaaaaatgtcctaaagtgtgcaacataattaaacaattatttatctttctgattttgaatgttaattttggtcttatatcctaaatcccacataattgcatttttttctgattatacagttttatacttggcaaaacaaatgctgtttaacttagggagttatctttctacagcaggatcccctagagtttcagaatatattccttgcacactgctctgtgtagagaagacgttcgtttacagagcctgtctcaacttcctaacattggtctgagcacagttttgttttgttttttaacaactttttttagaacagttttaaatttacagaaaaattaagaagataggatatagagagttcctaaataactttcactaaattgtcactattaacatcttgcattagtgtggtgtatttgttaccattaataaaacagtattaatgcactattagtaactaaataccatagattttttcacatatccctattttttttacttgtttttctatgttggaggatcccatctagtttcatttagttgtcatgtcccctacacgcttctaggttgtgacaatttctcatacttttcctcgtttttgatgacattggcaattttttttttttttaagtattggttaggtattttgttggatgtccttctattgcaatttgtctgatgtttctctcatgattaaactggggtgaagctttcttgggagggaagatcacagatataaagtgtaatgttcatcccatcatattatgggtatatactattaacatgatttgtaacttcatattgaccttgcttgcctggctgagatagtgtttgtcagttttctctgctgcggaatcgttcttttttttttttttgctgtttccacaccggactctttgaagtgtagccacacgtacagcccacactgaaaaagtagggagttattacctcttctttgagggtggaatatctgcataagttgaggagtttttatgcacattttctttatttttaatattcgtcttaatgtttatctcgtaagacaatgctgtttctgaatatttggcaaacacattttagagaagccaaattatccatatcttcaggcaattaatatgtttaaaattatactgagaactgatctaaatttctgtgtgatttaattatgaaacccagttttgtgtctagtttactggttttgaaaaagtgtttcaacaaaataacaactaaaatttattggttgctcattgtgtgatacgaactgttctaagaggtttgtatgtattatttgatactaaactcagtgtattacaaggaaatgtgtcttattactaatctacaattacagcttcaattattaaataactttccccagtttccacaattattgagtgatggatcagggaatttagtccagttttattcaagtgaggccgtgatgatagttataaaactggtattttatgttcaataattgtattaaatctaaggctaaaacaatgtattcagtaaaacttagaacacagatcttctgaaagttttggttctgaagtgttcatttcaatttcttatataattatagttgcatgatcaaatgaaatcatccccaaataactcaatgttcaaatgctagactacccatataacataggatcatctgagaatttcaactgtcaaaaaggaaatatgtctagatttggacttaggaagttgcagataggtgagtcatattctctccaaaaaaccatctttttggtttgttgaaaaacttagggagatttttcaagaatccataactaaaggtgatagagggtaggtaagtgttattttttccttttgttgatagaataagaacagaattttatgcccaattaaaagatttcatgatatgagttgttagaatatacaagtgtttcctattttcactgcattaattttactaggatacaattgcataacaaaattcacaagcagctgagaaatgttatactaatatcaggcaggcatagcagcctgggagcattttgcacgtgtgatactttagtcatcaaatttgtactctgaattaagtgtacttataactggtacttggacaagacactggtcatttgtacaagtttccaaacatagtgacactgattagaaatgcccttgttccagagacagccaatagaaagatgtgtaagattttgttttaatgcaaatagtaataatgcatttgataggcattgtacatagaaaatgacttagggattattttgccatcatttcatttcttataagaatggtgaccccttggctaaatttcatgttaacaatgtttctcatttactttggtcttataatttcagctgctctaaaataaatcttagataaattcattgcctactttgacatacatattttaaggcttcaaattctggaaagatctaaatgcctttaaatatcttgtttttagctacgctatgatcacactattttatcattttaaaaggatcagtgttatctaactgaggtcaccggcagaatgaaaagtcaaggtattagcatttatattttcaactgaattgacagagatctcaacaatgagtcattgaggggttattaagttcaggagctaataatatttctctaatatgattgctaaaaagtcaatgggatttgtaatttataacacaatcttgataaaatacaaaatagaatagctgttcccttaagacatcaacagttagtgtatgaagcatgtcacttttgtgttccaaattttcactcatattaatttgctcttattgaaattttgaaactgacttagcttcagtttggtttcacagatatatgtattaggcactttatcctttagggggactcaagcctctgaagatgatgatgccattgcagccaaattttacattcaaattctagcccaagactactgaacttataaagttgaggacactattataaaatattaatgattcaattctacttcaaaatttcatcttaagtaaaacaaataaaaaataaaaattatatatagctatcttaaaacaagcataattcgatatcccatggatatctaatcaatgaaataccatgtgaccatgaagagttttctattaatcacatggaaagtgttcataatgtattttacttggaaacagagtttatcacacctttagatctgaaattcaaaaagaaatgtttgaaaaatataaatagtcataaaggcagacaagtaaatacatggagcagagggggaaaagagatgagaaatttttcaacagaacaattttatgggaatagtcataaaggcagacaagtaaatagctggagcagaggggaaaagagatgagaaacacaaaggataacaatgttattatcctcaatttatttatttgtgctttttacagtttttcaaacacttaacataaattgtattgatatatatataaagaacaaaacgatgctataattattaaaacaattaggaattttaagtcatcttatgtttgttccttttatttttatttatttattattattattattatactttacgttttagggtacatgtgcacaacgtgcaggtttgttacatatgtatacatgtgccatgttggtgtgctgcacccattaactcgtcatttagcattaggtatatctcctaatgctatcccttttgtttttaaagaacctgaaatccaaagggcaatgacttaccacaaggagtaaagtgtcagtgtgggtgcagaaaccaaaagccagggcttcatctcatggtctagtgttgacttcactcgacctcaatgccttcctccttccttcccctgccagtttggttccttattagtagttcttttctaggtatcttaagcttggaaccttcgtaagaaaagggacttgaaatgttcttacacagaaggtaagaagaactttacaaattctctgagagtttgaggagaaagaaaaaatgttaaggggctggccttattaaaggtgggttaactttgagctgtatatttgcacagtaatatatactgtgaatcttagaattaggagttgtaagaatggaaacttaactaaaggtttattttgtgtgacactctaagattgtagtgtcacgtttaattccattttgttcctaagttaaagtgaaagggcatttttaagagctttgctgatttatgaatagtcaagcacatcacatattaataggatgtgtaatatggaagttgctattcactgttaaatatggtggagaaattagtgaaggaatgggtagaaattttgataaataatccattccccccccccacttgctggctttcttgaattgatagccaggaaaggtagaaaaaaaagaggtatgtaaagtcagactgaactggttgcaaactggacttcatgacttgctacatgtgatcttgatcagattacctaaattctctgagtttaacataagtttgcatttaaggggatgagggcgggagagagagagagagagagagagagagagagggagaaatataccactagtcttttgtctgtggtaagtgttgcaaatattttctcccagttcattggctgtcttttgattttttgtatagtgggtttttttcctgcaaaattttaaaaaatgatatagtcaaattcattgacatttttcttttattgcctctgaatttgagtcatagttagaagaccttttcttacaccaaggttaaagatgaatttttcaagtacttgtttgattttattttttacaccagaattccattccttttgcagattattcttgcatatgatataagatatggatctaaatttaccttttccaaatggctactttgttgtcccagcagcagttattaagtctatttttaagtggtttgaaatgctgctgttgtcatatactaaattctcatatgtatttagttttaaatttggaccttctattctattccactgctttatctgtctattcaatatgatgctagtataacatcattttaaatataaaggctttgtagtatcttttaatgtttagtaaggtagtcttcctcttatttctttttttacaaaagtattttccttgctattcttgtatgcatgtgattccatgtgaactttagtcaatttacctaacttcataatttgttggtatttttattaggtttgaatgaattataagtcaacttatggagaatttatgtccttatagtgttgagtcattttatccaaaatacagggtattttcctaatttttaaagtcttctttagagtcctttgtgagtgttaaaattttcctttcacaaactttgtacatttttattaaatttatttctaagtatttagtgttcttattgcttattcttattatagtgttcttattcttattcttattcttattatacatggacttactcttaagttctctaaatgttcgttgttaaagagtatataaaggctactaatttgttaatgttaattcagcattcagctaattcactagaatatttgatttcttgagatggttttatcattgaccctctggaattttcaaggtttattatcttaacaactgcaaatagaagtagttttacttcttctttaccaatttttatgcttttcaagaatttatctcatctaattgggttggctctcatcgaagaactgtagaataatatgggatcgtattaatcataacatgtattcttgcttcgtctcaaatcttaatgaaaatgcctctagcgtttcttcatcaaatagtataccggctttaagtttaaggcaaatatatttcattatgttaagaaaggatccctaaattctttttctttgagtttttttaaaacaataaattagtgttttttgttgttgttgtcaaaggctttcttagcatctgtgaagataatataattatgcctttaaattgtcaacatggtatatatgaaatgaattgggtttataatagtaaaccaatcttgcattcctaaaataaatcctatttagttatcgtgtgttattttcttaatacagtgttggattaagtttgctattttttattttaaaattttacattattttcttcagtgatattgacctgtagttttctttcattatactgttttatcagatttaggtatcagtgttatagtttcttcatgaaaggaattaagatgttttccttccctttcaatgttctgaataatcatacagcattatgactatctgccatttaaatctttagaataattaccttgtgaaactatgtgggcttggtgctattttgtgtagtatttatctaattgtttcctatatttcttctatgaaattggttgatttaatctttctaacactaataagattaatttgagtaaacttcatttctctagaaaataattaattcatcaaattaaatcaaatttgaaatttgatttcaaatttatttgtgtcaaagtaaaggaggtttcctgtcattttaaaattctctgttgttttaatagtaacttgtttcttattatttataactttatatatttgtactttttccttttttatcaaatgaactgagttttaacatcgcatttaattttaattatctaatctaaatctaaaagctgatatttgattcaattgtcagaaatctcttaagtatattgggatcaacttggaaaagtaaattgactttaaacagtacactttatgaactttaaattacagatcagatatttttagtaaaattttatccaaactaagatgcaatatgagtataatcactgattcaaaaagcttcctttagtgagcatgaaatatctcactattttaattttaatattgattgtgtgttaaaataataataattgcattatattattgataatgtgtattcttgtcatgtttccattcttactggaaatgcctccagtgtttctccatcaaatagtatactggctctaagactaatttaaaggacaagatggccaactagacacagccaggaagcactgttcctacccccaaaagaccaaagtttcaagtaaaccaacataacttggacagatcttcaaagagaaaatgcccagtggatgaagatgtgatgcagatgtggaggctgaggaggtaggaagctgggaaccttgttcagggtaggccaatgcttgagccaatcctgacctcaagtggctcctgggaatgggtgaatgaagaactgcaggactgcctaccctagccatggaccgctgggatcctggctatgggggccccacatctgccatggacatttgagctggcagaaggatccttccagagagtagacagagatggagctccagccagcatggaagcatgggcctttgtgcacagtgaggctgtgtccaaacatggacatagccacctattccccagggctccccactcaccgtctgagaagctctagctccagttgaccaccaggctaggaggaagctgggctgatttctctgtgggactggtacgtgtctgttctttaggccctcttgcccaccagcccctccaagggccactgtccagctgctctccaagagagtatgcatggctcagcttccactgcccagcctggttgctttgctccacctgattatgttcccggtggcctgggagcactttggattcccattacacctggaacctgaatctaggggtccagaggatggagctgcaagccaatcctggtgccccagagctgcagtgtgcagttcagaagcgcagagctgaaatttgtggccagcactcaagtgggagaagagcccaccctcttagaggactaagaggggtgacttgtgtcagttcatgagctggaatagaagcagaacatgtcttcttcctcagggccaaccaggaaagagtgttacctatctccctgctacgttctttgcccagggagcctcacgtcccagaacagctaaagaaagtaatgcaggcacagtgccagtgatcagaaggggctccaccaaggcccaagttcagacttggtgaggaattacctctctccccactgcactgcagagtgtggctggaaacatgaggaaatatagaggagctgggtggctaagtaagagactatttactgtccattattcttaagcactatccactggatcacagcccaaacaataacaccaaaaatgttttgctgatataccctgctgtaaaaccaaggacaaaaattcagccacaaataaagacctgtacagagcctagaccatctgaaaacattcagaaacaaagccaattggctatactcaacttatactgtagttaaaggaacagcaaccctcccagatgagaaagaatgtggacaagaactctggcaatttagaaaggcagagtgtccccttaccccaaaatgagtccactagctccatagcaatggtgcttaaccagtgtgaaatgacataagtagaattctaaatctggatggcaagaaagttcaagaatcaggacaaagttgaactaaatctaaggaatctagtaaaacaacccaatagctgaaagatgaaataacatttcaagaaacaaccaaactgaacttctagagctaaaaagttcactacaagaattccattatacaatcagaagtactaataggaaaacagaccaagctgaggaaagaaaatcggagcttgaagaccagttattcaaatcaactcagtcagaaaaaaataaagaaaaaagaagtttttaaatgaacaaattctccaagaattatggtattacataaagagatcaaatctacaactcactggcattcctgagaggggagagagaataaaaaacttggaaaatatatttgagaatatagtccatgaaaatttccctattctctctagggaggttgacatgcaaattcaataaatacagacaagcccagctagatactatagaagatgaccatatccaacgcatatagtcatcaaattcaccaaggtcaacgcactcacacaaaaaaaggcagctagagataagggacaagctacatacagagggaacctcattaggctagcagcaaacctctcagcagaaactttataagccagaagagaccagggccctattttcagcatccttgaagaaaaggaattccaaccaagaatttcatatcacaccaaactaagcttcataagagaaggagaaataaaattcatcacagacaagccaatgctgagaggattcatttcatttagaccagctttacaaaaataccttaaaggagtggtaaagataaacacagaccaggtacagtagctcacacctgtaatcctagcactttgggaggccaaggtaagtggatcacttgaggtcaggagttcgagaccagcctggccaacatagcaaaaccctgtctgtgctaaaaatacaaaaattagcccggtgtgctggaatgcacctgtaatcccagctacttgggaggctgaggcaggagaattgcttcaacccaggaggtggagattgcagtgagctgagatcttgccgctgcactccagccttggtgacagagcgagtgtctgtctcaaaaaaaataaaaaataaaaaggatgaaataaaacaatgacacctgctaccacaaaaacatacttaaacaaacagcccacaggcactataaagcagctaaacagtcaagtacatacgacaactagctaacaacacaatgacaggatcgaaatcttacaccaacactaaccctgaatgtaaatggtctaaatgccccacttaaaagcttggagtggcaagctggataaaaggacaataccctatcatgtgctatcttcaagagacccatctcacatgtaaggacaaccacagactcaaagtaaaaggatggagtgagatctaccatagaaatagaaaactaaaagagcaggagatgctattcatgcatcagataaaagactttaaaccaatgaaaattaaaaagtacaaagaagagcattacataatgataaagggtaagatccaacaagaatacttaactaccctaaatatacacacccaaactttggaacacatagattcataaaacaagtttttcttgggctagaaaacacttagacaaccaaacaataaaagtgggggacttcaacaccccactgagagtattagatcactgaggcagaaaactaacaaagaaactctggactacatttgacacttaactaattggacctaatagacatgtaaagaacatctcacccaacaacacagaatttgcattcttctcatctgcatatagaacatattctaaaatgcaccaaatgcctggtcataaagcaagtctcaataaattcagaaaaattgaaataatacaaaccacacagtgcaataaaaatagagatcaatatcaagactatctctcaaaactatacaaataacatggaaattaaacaacttgttcctgagtaactcctgggcaaacatttaaattgagaccgaaattttaagacattatttgaaattaatgaaaatagggacaaaacttaccaaaatctctgggatgctgctaggaaagtttatagcaccaaacaccatcaagaaattagaaatatctcaaattaacaacctaactttgctgctaaaggaactcgtggaaaaaagaactaatcccaaagctagcagaagaaaagaagtaactaaaattagagaagaaatgaatgaaattgagatgcaaaaatttatacaaaaatccataaaaccaataactgtttttttcttccaatagtttttggggaacaggtggtttgtggttacatggatgacttgtttcatggtgatttctgagatgttcgttcccccgtaacagtagctgtgtacactgtacccaaggtgtaatcttttatccctcacccctctcatcctttcccctgagcccccaaagtctgttatattattattatgcatttacatcctcatagcttagctaccacttataggtgagaacataacgatatttggttttccattcctgagttacttcaacttgaatgatggtctccaactccatccaggttcccgcaaatgccattattttgctctttttatggctgagtagtatttcatggtatatatacaacacattttctttatccactcatcgttgatgggcatttaggctggttccatattttttgcaattgccaattgtacttctataaacatgatgtgtgtgaaagtgttttttcatgtaatgccttcttttgttttgggtggatactcagtagagagattgctcgatcaaatggtagttctacttttagttctttaaggaatctctataccgttttccacagtggttgtactagtttatattcctaccagaagtgtaaaagtgttcccttttcaccacatctacgctaacatctattattttttgatttttaaattgtggccattcttataggaataaggtggtatctaattgtggttttgatttgcatttccctgataattagtgatgttgagcattttttcatatgtttgttggcatttgtatatgctcttttgagaattgtctcttcatgttcttttcccagtttttgatgagattatttgtgtttatcttgctgatttgtttgagttccttgtagattctggctattagttctttgtcagacacatagtttgtgaagattttctcccattctgtgggttttctgtttattctgctgattatttcttttgctgtgcagaagctttttattttaattaggtcccatctatttatttttgcttttgttgcatttgcttttgggttcattgtcaataaatctttctttaagccaatgtctagaagttttttcgatgctatcttctggaatttttatagtttcaggacttagatttaagtctttgatccatcttgagttgaattttgtataagatggaggatgatgatccagtttcattattctacatgtggcttgccaattatcccagcaccatttgctgaatagggtgtcctttttccacttcatttttttttgtttgctttgttgaagatcagttggctctaagtatttggcttcatctctgggttctctactccattccgttggtctatgtgcctatattttataccagtaccatgttgttttggtaactatatccttgtagtatagtttgaaattgggtaatgtgatgcctcaagatttgttctttttgtttagtcttgttttggctatgtgggctctttttgcttccatataaattttaggattttttttttctagttctggaagaatgatgtgaagaatgatgatggcattttgatgggaattgcaatcaatctatagagtgcttttggcagtatggtcattttcacaatattgattctacccatcagtgagcatgggatgtgtttccatttgtttgtgtcatctatgatttcttcagcagtattttatagttttccttgtagaaacaaggagttttcacctccttggttaggtatattcctaagtattttattttattttttgcagtggttgtaaaaggcattgagttcttgatttgatcctcagcttggtcattgttggtatatagcaatgctactgatttgcatacattaattttgtatcctgaaactttactgaattcatttatcagatctaggtgcttttaggatgtctttagggtttcctaggtatagcattatataatcatcagacagcaacagtttaatttcttctttactgatttggatgccctttatttctcttatctgattgctctggctaagacttccagtgctatgctgaatagaagtggtgaaagtgggcattcttgtcttgttccagttctcaaggagaatactttcaacttttttccattcagtataattttagctgtgggtttgtcatagacggttttgattactttaaggtatgtcccttctgtgccaattttgctgagggtttcaaacgtaaagcgatgctgaatttcctcaaatgctttttctgtgtctagtgggatcaccatgattttggtttttaattctgtttatgtggtgtatcacatttattgacttgcatatgttaaaccatctctgcattgctggtatgacgcccacttgatcatggcgtattatctttttgatatgctgttggatttggtgagctagtattttattgagaatttttgcatctatgttcatcaggaatattgatccgtagttttctttttttgttatatcctttcctggttttggcattagggtgatactggcttcatagaatgatttagggaggataccgtctttctgtatcatttggaatagttgtaagtttggtacaaattcttctttaaatgtctgatagaattcagcagtgaatccatttggtcctggacttttatgttggcaatttttgtactactctttcaatgtaactacctgttattggcctgttcagtttctatttttttctgatttaatctagaagggttgtgtatttccaggtatttattcaactcctctagagtttctagtttgtgtaaaggtgttcatagtagccttgaatgatcttttgtatttctgtggtattggttgtaatatgtaccatttcatttctaattgcgcttatttggatcttctctcttgttttcttcattaatattcctaatggtctatcaattttatcttctcaaataaccagctttttgtttcatttatcttttgtattttttgtttcaatttcgtttagttctactcttatctttgttatgtattttttcccctgctaggtttaggtttggtttgtttttgtttctctcattccttgaggtgagaccttagattgtctgtttgtgctctctcagacttcttgatgtaaacatttactgctatgaactttcctcctagcattgcttttgctgtactccagaggttttgacaaattgtgtcactattattattcaattcaaaaaactttttaattactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagctttatggggatggcattgaatctgtaaattaccttgggcagagtggccattttcatgatattgattcttcctacccatgagtatggaatgttcttccatttgtttgtatcctcttttatttccttgagcagtggtttgtagttctccttgaagaggtccttcacatcccttgtaagttggattcctaggtattttattctctttgaagcaattgtgaattggagttcactcatgatttggctctctgtttgtctgttgttggtgtataagaatgcttgtgatgtttgtacattgattttgtatccacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatagccaaatgactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaattttttttaacttccatcttgatttcgttgttgacccacagattattcaaaagcaaattatttaattttcatgtattttatagttttgagggttccttttggatttaatttccaattttattccactgtgtctgagcaagtacttgatataatttcaattttcttaaatttattgagacttgctttgtggcctatcatatggtctatcaggagaaatttacatgtgatgatgaaaagaatgtatattctgcagttgtttggtagaatgttgtataaataccttttaagtccatttgttgtaaggtatagtttaagtccattgtttatttgttgagttcctgtcttgatgacttttctagtgctctcagtggagtattgaagtcccccactattattatgttgccatctatctcctttcttagatctggtagttattgttttgtagatttgggagctccagtgttaggtgcacatatatttcagattatgataatttccagttggactaatgcttttatcgttatattatatccctctttgtctttaattgttgttgccctgaagtctgttttgtctaatataaaaataactactcctgctcacttttggtttccgtttgcatggaatatctttttccatcccttgaccttaagtttatgtgagtccttatgtgttagatgagtctcttgatgacagcagatacttggttggtggatttgtgtccattctgtcattctgtatcttttaaacggagcatttaggccatttacattccatgttagcattgagatgtgaggtactgttctattcatcatgctagttgttgcctgaataccttgtttatttttaattgtgttattgttttataggccctgtgagatttatgctttacagaggttctattttgatgtattttgaggctgtgtcaagatttggaactccttttagcatttcttatagtgctgtcttggtagtggcgaattctctcagcatttgtttgtctgaaaaagactttatctctcctacatttatgaagctgtgctgctgtatacaaaattcgtggctgataattattttgtctgagaaggcaaaagatgggaccccagttccttctggcttgtagagattcttctgagaaatctgctgttaatctgataggtttttctttacaggttatttgatgctcctgtctcacagctcttaagagtccttcctttgccttgctgtagatgagctgatgactatgtgcataggtgatgatctttttgcaatgaatttcctgggtgttctttgagtttcttgtatttgggtgtctagatctccggcaagaccagggaagttttcctcaattactctctcaaataagttttccaaacttttaaatttctcttctttcccaggaacaccaattattcttatgtttggttgtttaacataatccctaatttcttgggggctttatttttttattttttatttctttatcactgttggattgggtttatttgaaagccttgttttgacctcggaagatcttcttctacttgttatattctatctttgaaactgtccagtgtattttgcatttctctaagtgtatctttcattttaaaaagttgtgattgtcttttctttaaaatatcaatttctatggaaactttttcattcgtatcctatattgttttttaagtttctttaagttggttttcaccttgctctggtaccttcttgagcaactaaatattcagccttcttaattctttatctggcaattcagagatttcctcttggtttggatccattgctggatagctagtgtgatcttttgggagtgttacagaaccttgttttgtcatgttacccaaattacttttgtggtttcttctcattagggtagactgtgtcagtgaaaagatctggaactcaagggcttctgttcagatttcttttttcatggggtgaccccttgatgtggtgctctcctcctttccctagggatagagctttctgagagccacactgcaatggttgttgttgcctttctgggtctagccacccagcagggctactgggctacagactggtgctggggaatgtctgcaaagattcctgtgatgtgattcatcttcaggtctccaagctactaccagcacctatactggtggaggtgggaagggagtgaagtggactttgtgggagtccttggttgtagttttgtttagcgcactgcttttcttggtcggtggttatgtgtagttgtcacatggacagacttatgacctctggttagccagggtgttgcaggaggtggaattggctgttctccttctttggagcaagcttgttctgttatgagttacaataatggcttgagttggttggcctccatccaggaggtattaatttcaagagagcaccagctctgttagcagaaggggagtatacaagtgtatattcctgtatattcctggccctatgttggccagggtaagtacttgggtttctcaggtgatagcaagggccatagagctccaaagaggtttttttgtttgtttgtttgtttgtttgtttgtcttcagctaccagggctggtaaagagaagatatcagttgggtacagggttaggctgctctgagctcagactctccttgggtggggcttgctgcagtcactgtggaggatgggagaatggttttctggccaatagaattgtgttccttggggggattatgcctgcctctgctgcatcatacaagtcgcctggaagtggcctcacccagctcccacgcagccagaaaggccagtctcagtactaccaatcaccaccaacagcgctgagtttatatccaagcagcctgagagcagggctgagatctcaccccaggctacaagcatccccactgagaaaacaagcaaggctctcaggcctcacctctccccacctgcctgtaccatcagctgtggcttctacactcatatctgcacttactgttcaccccacccccacccagagtctgctcagaaaaagttgtgctcggtcaaaattattaagaagttcagctcgaagttttcttcaacctgtgacaccttctaaattcttctggctgccttccccaaggacccctgtgaggtaaaaccaggaatggcttccctgggctcaaggtggggactggtagtacctacggggactggtagtacctacagggctcttcctgctgcttcttctgcttttatatttcactctgattcctaaatccatttcagctctaggtaaggttaaatccttctcctgtgacctggacctttaggttccccatttgggatgtgtttgggatcagactttttctcctttcactctggaaacacgttttttttcagctgtctttcaaagtttgcagcagcaagctacttctttcaaagggtctgtgacttttttgggttttcctgatatgttcctgcagtggttttggagcaaaagttcacaatgcgagtcctccacatgctgttctgtccatccaagtgggagctgcaccttagtcttatctcttatccaccattttctggaagcttggaatacaaattcattaacaagctattcaaaggccaagacaatgtgactctaatcttgttttcagtaactccttgcaacactattctttagctatatggagatatttattgagcctcacacaagctcctactttatgccttccacatgctgtttgcactgccttgaattctctgttgcttctaatttgaattgtatgcattttaggatttctcttagatgccacattttatgcagccttttctaactctaccatgtaaaattaattcctgtgcattattttatttgaatctttcttgtgatactcatcattttttatttttcggtttccctaaaagtatgctctttgagtgaaacattcatgtttgtctttcacatttctttctatttacattcataacccattttaagtgctttttatacaaaaattattcattaaatatttgttcactgtatgtaaaaggttgacatctcagggtgaagagaattattaaatatttttgaagttggtttatataatattagcttttacacactttctgtaagtttttcaaagtattttttgtctgtcatatttgcatttatttgtttaaattatatttgtactatataaatgtttaaaaaaatcccttttaataaaaacttaattttatcttaagtgtaagctagagttagcttagctacttattaattgtttctaagttcaaaattactgatttgtaaacatgtattagaagatcacagtgttaacagagtggaatgaattatccacatccctcaagtggtggctgcaacttagacccatggattctgtactagattttacataaatagaagtcataagacagcatgtagtgtaaaggatgtttgttactttttttcatcacttagcatctataccatatatctttttttggataattcaccactttaagagtaagtagatggcagagattgactctgtagaagttgaaattagcacataccaacgttttattcatcccttgaaactagggcaatgtcagtcaatgggatgcttccaactgatcttgaaattaggaggtgatggtgcaaagaatcaccaagctgaaggattgactgagtatctactgcagaggtagacagtggcagcctaaacatgtgactttcagaagcaacagggtaaatggatcactgcggtagctatagctttgaagtctgtggcatatgctcttcagaaactaaatgtagttatcctcactgatttagttttatgaaaagatttttattgtggtcttcttggctgcctattttttcttaatcctctccatctttgagttcagttctctggacttcctgatagtactctgatcaatcaaacatccattcaatggattctctttggctaattctgccatagtcaattactgcagcaactgacaactatgactgttaaaactatactcttttggcaccattgctggatgtatggtatgcttacttcttctctaattttttcccttccttttctagctagataaatatttgtttagccttttcatatattttctttgtatcataatttgaactctcttctgaattatcaccagaatctccttgtacctcttcaatagtggagggccaaaactcagcacttggtgaatcttggtggtttaaaaaatggtaaagacatagtccactctactatttagtagttgtgtgacttttagtaaattaatgaaccattatttttcattgtaattctgtaaaatgaagacaatgttactgattttatgggatttttataagaattaaataatgttagcaaagaccaaagacaatagcacagttctcacacatagtaggcattcagcacagtgaatagtagttatcattagtaattctgtaggctccatattgcctaaggacctaaagatatgatatgtattccctgtgtgtgagataacaatctctatagtcaatttcagtttgacttatataatatccttgattttattttctcaaaattatgcctgtttacttggtacttgcttttaaaatggtattcaccgaagctttaacatccagtgattaacagtgagagagagtaaggctctttttaaaccaccagagtgtgttagggtagtactgagtcaaagtctaagagttttatggttaaaaaaacaaataactttttactgctgctcatttaagtaggattttatgttgttcccaagatgggagtctacaggcaactaataagcgggaagaagtgactgtgaagacaaaccagctgcatcaaactgcaggcacctcaggaatcagcagatcatgcagggcacaaagaggtgaaaccagtcaagtgtacagtggagacgatttctcaattttttttccttggaatactagcatcactcaaaaatgtcaatagtgtttggtgaacaaaataagctttttaaattaaatgtacagaaatccctgcttatcagaatgacaccttgaattttcataatacatattagtatacccaagtaaagaagcctgtctaatttttctgagatctttatttctcccaatttgctggaacatgttttatttttaatttgttttctttgatttgcttttacaggaactttgtaataatctaaagaacgcagttgctataatttgataatgacaaatgaaattatgaaggtaattctgagcaattgcgaaaactcacaaacaacagtctaaatatttggagctttatactctaaatactggggagccactaaagatttttaaagtagaacaatgaagaattggtgcattacaaaaattagttgacaatcatatttagactttatttgaaagataaggaaaaatgatagaggcaagggaatcaattgaccagctattgtgatatctcaattttgaaaaataattaaaaattagaatgaagggatctatgtaaaaggaagccaccaagagaagtaattaattcataggacatgatgattaatggatgtggatgaggaggaaaaaggaggttgaaagaaagtagtaaaaactggcaagagagtccatgtctgaataagaagataaaatgtcacactgattaatactttaactgaccaaatcaagacagtgagattgtttgtggaagaatattgcaaataatttaggagctttaaaattgtggacttattctgatgcctccacctaaattgtctggtatcaaaacttgctgatggttgcatcatgttccagctttccatcttgcattttctaactcagtaaagagttaaaaggtgatttaaaaaaaaaaaaaaaaacttcctttggcatggattatgtcagctttcatctacatgctatgcaaaatcatgtcttggttagtatttttcttatcttttgatggttgacatgcaagagagaattaaacatcaagataattagtgaatcctggtgatatggttcagctgtgtccccatccaaatctcatcttgaattgtagtttccataatccctacatgttatgggagggacccaggaatcatgagggcagtttcccccatactggcctcatgttagtgagtaaatctcatgagatctgatggttttataaatgggagttcccctgtacaagctctcttgcctgccaccatgttaagatgtgcctttgctcctccttcgccttccaccatgattttgaggcctctccagccatgtgaaactgtgagtccattaaccctcttttgctttataaattacccagtctcagatatgtctgttagcagcatgagaacaaactaatgcacctgaatactttagtgttttttagtagaatatgacatattatgagtacacaatgtgaagaaatccggatattcgaaagacaaacatttctgaatgaaggggaaaagtaagctggggcaagacaacgtttctcatccctgattgaaatgttcctatttaccccctaacttataccttgggatgttatgttgcttgtaaagaattgtgcagagacagatggaaatattaaaatatttatcctaaataaatgtttgagttaaacggtaatatcctgtgctgctctagattcaattctatcaataagctattttgagattctgacctcagtttcttgtcttcttttaagttatctctgggccctaaagagacacagctatgaaactggagaatgactgcagaataaccaaaagaagttatccaacagaatttataagatataggatttcgtttcaagagagaaaacaggagtaaaaatataaattttgggattgtccacattagagagaaaaatcatatcttcatatgaagaaatatagaatttcttcaaaaaagaaaatataagggaaggagattggaatattaaagaaaatctcagagaacatccacaactgaattccaaaaacagaggaagaattatcatgaatggcaaaagatatataacaatatacgaatgaagagaatatatccactagagaattataagagaaaggaaatcaatttaggtgaagaaagtctaagaggaaggggataaaggtgactaaatttggtgataaaaaattgaggtaggcaaaataatggcctccaaagattcccacattctaattcttgaaattagtgtttatgttatgctaaatgacaagggagaattaaggttgcagatggacttaaggttgataatcaactcactttaaaaatagagagactgttctgaattatccaaatgggacaaatgtaatcgtaagggtcctttatatgtgaaagaatgtgaaagagggcagcagaagagtcatcagactggttcaaggtgagaaaggcttggttggctagctttgaagatggaaggtttcagaagccaaaagatgcaggctgactctagaggttggaaaagcaagggaatgaatttactagaaaggaacagagacctgctgacactttgattttagctcagtgagatccaatttggacttctgagaaaataagttttacagaactgtaagttacagaactgtaggaaaataagttggtgttgttttaatccactgagttgtaccaatttgttacagtagcaataggaaacaaacatagaagctcattgtttgcgtagatacgcagtgtcagtacaaaggacaaagacctattaacagagttacaaatgagcaatggaagtagcaggtgttgcccatattttcagcagattaggcagtggaataagagaataggataaaaatatctgagaaattgttaattggggaaaaattcaaatacatctaattaaatagaaatagcattgttcaagacagaagctctattatattagctccttctttgcaactaagcagaatatttcttgagaagattatatgagcataattgtcaaaccaagcaaatgaaaatctcccaaactaatggatgtaataagtgagatctagaaactcacagaaagctgtttcatttaccataaagaataatgaaaagtctttcatctctaaattgtatgaagtgagaaattctgccaattataaatgagatgaaaacgaatacttaagaaaaattctggcaacttcataaaaaatgccaattttacatattagaagaaaaaacatattatgctgttgacatgttaagtgcatcaatagagataatgaatatgaatatgctaaatcaaggcatataaaaaatagaagactaggatattctcaaaaaattcagtttatatagaaagccagcctggttttttacaaaggtttgtataaagaagtacagaaatatttaagggtagaagaaaaataagcagccatatgctactctaaatagtgctgagttatatgggccacttttatgcaaaatgaattctattgtaaaacacaaaaataatgaaaaaaaattgtctctatgttgatttgacagaacttacggttaaagctaatgatgcagttttagaataaattttcctaaatctaggtagagaaactcaattgtcaaatgaatgatctagacccgatgacctactgggttccttctaaagtaatggccccaggtatcctagtgcttgagaaatacgtaagcattgcttgaaaagagcatgctggggcccaaggtttggtaagcgctttatgaagttttgctgcttgccttctcagaccctttagcacataaatttctaagaaaatacttctaaatgaatcattttccctgataggtcttttgataacagaaaaggtttttgcccgtggatctcaaaatacttgtgtttaacacattaaactgttagccataaatcaatttagagtcctaaaacaataatgaaaaataagtcagaatcattttgacatactgctttctaaatatacatttttcacagaccctttgtgttataatcaactggtaacttcattcttctacttcctaagattgtacattcaccacttggatggtgtagttatgagcactcaattatttttttatctgaggaagtcttccttgagctgttagttcagatctctgggcactgacatctcctgttcatttcatattcttgattgtcacgttacttttttttttttgaggtggaatctggctctgttgcctaggctggagtgcagtggcgcaatctcagctcactgcaaactccacctcccaggttcaagcagttctcctgcctcagcgtccctagtagctgggattcagacgcacaccaccacgcctggctaatttttgtatttttagtagagatgaggcttcgccatgttggccaggctggtctcaaactcctgacatcaggtgatccacccgcgtcggcctcccgaagtgctgggattacaggcatgagccaccatgcctgacctgtcaagttactttctatacacttggtgacgctttggtcttttctgttaaatcactctcagattcccgaagtgtttttcttatttaggaatagcaatactgttaattagctaagcatccgtgatgccattcactttttatggcttatctcaaccctttcaacaactttgtgctagaggtcaatttaaccgttttgccacagagaaaacaaaaggctaagaaccccatagcttatacatggtagagtcaacattcgaacccacctttgcttttcttcaaagctggtcttaagggtaatgcccaattttcttgccctctctattccctatcgtaaattccaccctcaaaccacctacaatttcagacatatttccattgtttgaccctaggtggacaagagaagagagatattacttaagagactagaagtcaaggactagattttactaggtaatcaccaaacctcacaccagagctaagagtttctgaactcactcatgcccccgggtgctgcgtgactctgaaactcaatgtcaggccttatgaagtgatcatgagctccctttggaagcagccacctctaccatttcctctttcccatctgcttctccatgaggctcttcgcttccttgagaaacttggcttcacacctatgagtaattctctgtctcctttttaaccgtacaccttcaatcaacagcccttctgtttctcttgccacagatctccacagaggcctgaaaaagtgatttatctgagcaaaggaggtcttctttattcagtgccattgctcccagatgttttcttctgattctagaaggcagatttatgtcgttcctgttacctcagcccatgaagctcaggtaaccacaggcaccttctggccgtactgtattaaaattatattctcctgatttacatacattaggtttatgagctattggaagcacctaataactttgggcaagatgatcctgactttatttttttattttagattcagggggtacatgtgcaggttggttacctgggcatattgcatgatgctgaggtttggggtatgaatgaccaggcactgagtaaagtaccagtaggtagttttccaacctttcccttcctccctccctccactctctggtagtccccagactttttttatgtgacaatatcatttttatttttctaacaaatctttcttcctttttttcttttgaagataaacatggatttaataagaatcagataattccacttagaatcatctattgggggggctattttaaaatgctggtgtctgatttaattgctttggagaggacctgagtataaatattatttttaaaagcacccccggtgattccagtgtgcatctgggaatgagaacccttgttgtcggcagcacttctcaggttcatattcttaagtggggcaaccacacatgctagtttgccttaagtgagtcctggtgtaattattcacagtacttcctgctattctcagaatctccactttgggtgataaattatatggctaccctattcatgaaaatcatctgggaagctcattaaaaattcagattatctaatctcaggtcagaagattgagtttctgtaggtctggggtaaggtttgagtctgcattaaaaactagtaaaattgtcatgagttgattctaatgcaggtgatgtacacactccaactctttttaaaatagattatttcttttggaacagttttagtttcacagaaaagttgagggaaaatacagagatctcctatgggctccctgcccctgaatacccacaggctggctgactgtgagagtctcacaccagagtggcagatttattacaattgatgaagctacactgaggcatcattatcactcaaagtctatggtttacattagggttcagtcttggtgttgtgtgttctatgaattttggcaaatgtataatgacatgtatccaccatcgctgtatcggaaaaatgtttcagtgccctaaagatcctctgttctctgcctattcatttctttctctcccctaatgactggaaaccactgatctttttacagtcttcatagttttgccttttccagaatatcatatagttggaatcatacagtatgtagccttttcagattggcttctttcactgagtaatacacatttaagtgtcctccacgtcctttcacggattcttagctaatttttttctgaatgttcatgtagtttatcctttcactgaatgaagaacaactttatttcttccaagttttggcaattatgaataaagctgctataaacatatatgtggagtttatctagtggacatagttttttaacaaagttgggtaaatcccaaagcgcacaattactatattctatggtaagaacatatttagttttgtaaggagctgccaaactctctttcaaagtggctgaaccgttttccattcccaccattgacaaatgagaattcctattgctctacctcctcaccagctttcgatgttgtcactgttttgtacatttgccattttaatagatccctaatggtatctcctttttgttttaatttgtaatttcctaatgacatatgatgttaagcatcttcccatacgcttatttgctatctgtatatcttttttagtgatagttttaaagtaaggtgttttgtctattttttaatcaggttgttcattttctcattgttgagttttaagatatctttgtatactttgaataacagtcctgtatcaggtatgtcttttgcaaatattttcacttagtctgtggtttgtcttctcactctctcgacactgtctttttcagagtagaagtttttaattttatgaagtccagcatatcaactctttgtttcatggactgtgcctttagtgttacatctaaaaagtcattgcaacacccacggtaatttatatttttctcttgtattatcttataggagttttatggctttgcattttacatttggctcgatggtccattttaagttagtttccgtgaagggtgtaaggtctatgtccagattcatttttttgtacttgtaggtccggttgttccagggccatttgtttaaaagactatgtttctctattgtaatgcttttgctactttcaaagatcaattgaatttatttgtgcaggttgtttctcagctttctattctgttccattgatctatttgtctattatctttaaagtaaggtagtgttaggcctccaactttgttcttctccttcagtattgtcagctattctgagtcttttgcctctccatgtaaactttagaaattctctgatatccacaaaatatattgccacactgtccttttaaaacactgtttagggtctgaactttaaaaacatcggaacctataatagtgtgtgttagatattgtcaagttttccgtattctaaagaaagatactcaaaggtgaataatggatctgtaatttaaataataataaataatagttaatgaactctcacaacgttctattttctcctatttgtcctatttgatccttaaacaacatagtgaagtggttatgaattctgttgtatgaattaagaaactgagaatttgaataattttttctaaatgtgtacagttagaaagtggtagaattttgattcaaatttaggttaatgagccataatgctttattatgattgtgtaatgtcatttcccaaacactgttcactgatttaaatctcacaaaatccttctgatacagactgtaaaaggcctgctaatttagacaggtgaaacgactttaccatttatgatgttatactggtagtgtaatgaaggcagaatatgaatatagatcttttaattccctaaccaatatatgttcttctcttttacttaatgtagattaaatgacgatctgcttgttttcatttaaattttaaagacctgtgaaaaccactatacttttgtaaagaaggaaaaacaaacgttcacattttgaggtagatagaaatgtcttattacatgctttggcaactctttctgaaggttaaaacatattagaaagccccatctcttccatttctaacagtaaagccaccctgactagctccccaccttctttgtaacttatctcgtatttatcatattcaaatctgcaatcttgatgctattttcgtgatcgtaattcatgctcaacaatctgcttccattctcaactcagtgagctggcaatcaatttcttagtgctatttgagaagaaagcaaaatctaaaaatgaagctattactatattacaagtaagtactaaatctgttaggtaggggctgacagatcacattagaatgtgtgccctgaggcactgtgaggcatgagaagggacttgtgatgcatgacactattattgacctttgagttacacaatttatcagaaaggaaaaaatagtttcctttgtgtcggtaaaaaccagtaagtgagccctttagtctagatttccaggagaagcaaattggtcattgtaaaagttcactaattcggctgtttattctcccaaacagaaatgggattgttaccacctgaccagcatgcatttagcagagcagtccttagctaaatattacatcagaaaccagggtaagaagcaggctatattgtgagaactattagaagtggttggcctatcctttaattggtgtttcacactgctctgcttccctacttaccattatacatactcacacgattacaaacttaacattacaacataataaacatcacggtgctctgtcattaatagagcacttcctccaatttatgcatgatacttagctctaaacttgatttatctgatttaatccttcaaatagtctacgacctaagttttttttttttgtttgtttgtttttgagacagagactcactccgtcatctaggctggagtgcaacaatgcgatctcggctcactgcaacctccacttctttgggttcaagcaattcttgtgcctcagcctcctggatagctgggattacaggtgtgcaccaccacgcctggctaatgttttcatatttttagtagaaatggggtttcatcatgttggccaggctggcacaatcctagtagtattatgctcattgtgctgttatggaacttgaggctttgatgattaagatgagttgcccaagtttgcacagctagtaagtgccagaactgaaactcaaatctaaggggaaatgggctttatcactgtattcttaagcatttctctgcattgcagtgtatgtaaaatgaatggatagtacttgaaattagtcccggacaattaagtctatatgtgatgtattcaaaatcagttgaaagttctaggatctaatcactgccatagtgcactccaggtcatgcaacaaagcgttaccccttttttgttgttgttcatcattcttatctaaagaggattatattctgaggtctttattgcattcacagcattcctgagagccacatgctatgagaaccctctttttttctcattttaaaaaagttaactttattgggatatatatataatttacatagaataaattttaccttcttatttgttcagttttatgaattcttataaactcatgtaaacaacatgagaatcaagacaatttccataacccaaatggttcatcattaactgtaaataaactttttatttagaacagatttagagttagaaaaaagttagtagtacagcgagttctcatgtaccctccacccacccagtatattccctgttgttagcatcttgcattagtacggcattgtgatctttttctgtgccagcatttcatccaagataccatgtttacgtatagtcatcgtgtctcctcgggctcctctagtctgtgacagtttcatagactttccttggtattgataaccctgatgactttgaggactattggtcaactattttgtagaataactctcatttaggatttatctgatattttcttatgattagactggggtcatgtgtttttaggagagagactacagagataaagtgccgttctcatcacatcatatcgagaccatatgctatcaacatgacaaatcactgttgttgttgacttttattacttaactgacttagtgtttgtcagatttgtccactgtgaagttattctttcctgccttgtctgtaaaatactttttaggaggaagtcactatgtgaagcttagagtggggagttatgccctgccttgtttagtggggaacacctacacaaattatttggagtaaacagaggatttgtctatttccttcatttgtttatttatgcattaatttaatcattaatttatatcactatggactcagatattttatactttgggttataatctaatagcacattttaagtttcgttgctcatattgtgctagctacagccattagaagctctttcagttgactactgtgtccttttgacatatccccattgttgttttctgttggttagtttatttttgctttatttctagcacttgttctctgggaatacaaactatcccaggataatcttatgtattccctgtccaagctcccaaatcaaccatttctccaaggggttctagttccttttagtcgagaagccaagatctgggtgctagaggtgctcactgctaccagggtgttgttccttctatgtcccctcagatgatggagaaagagatgtatatgtgtatactagctcacgtgtgtacacatatcaaaaataattccctgtgtatcatgctaaacgtgaattgtactgataccttctactgtaattcattataacatggcttattctaagttgttctccctttcatgtttctaattcccatcccaacaatgagcgaaacctatcccttgctagctgccattgatttacttacttgctcagttcttgtatacatgtatatgggttcctgaattgtttacttgtatccccatgggaaacaactttcccaactagagtgcgtacgcgcagttcattttgcctttggttttatagcctctgtgtatttacaaaattaattagggccatatatgctgaccttttatgagaaaatattcaaatcagcataaaaaataaagttttatttagtgtatagctacattgtgaacagttttaaaattctagagttacttacaatcatggatgtgtattcatgtaataatagttttaagtctatggtgttcattggatagtctaatattatagcagttatttttcaattaatttttaaagcttttatgtttttggttttctggtctttccatttcatgcatcattaaaaggagaattctgtaaaacaaaacattttatataaagatgaaatatggaaaatatttcctataagctgtctgtattattatgtattttaatggacttaaaaatgtataaaaatatgtttaaatatttgtaactacactccatatatcaattaagaaattggctgcaaatatgtgactttaaggtacgtcttttagaataaataattgtctacattcttggtaataaaatagtattattctgaaaatactaagcaaatgtggctttttatcacctgaaatagaaaaccttgacaatttcaatgctttctcctgctagatgaatcttatgagatcctataactcacccaaactttaaaaagcaatctcatctcaaactattctttccaaagttctcttttggaagttcaagggtatgttttaaaaaataattaagtaaccatgtaaattgagaacaaaatagatgagctgctgtgttttctgtataagtcatgctggatgcaaggttaggattttaagttccataaaatcaattatatacacaagctgaaatagtatctgagactaaggtaaatagaatgagcagggcatcaaggatacagcagtcaaaaacagcaaacctttcactgaatatcagatataaaacatttaggaacctgccttgaagaaatcttcttttgattaaaatttaatgatttatatttataaaatgagtagctctgaggttttatatattcataacgtcaagagtttctcagatacttcaagtacattcaagcttttgtaatgaagattcattttaaattaatgatttattactttcagcaacattttaaagtagtttgtagtatgatgttgggctccaaagaaaaacaattgcctgaagaactgtatcaggtaaaccttctctgtaacagacttcaaaagaaaatggctgagacaaactgggatgctggaaaactgcaggtgtacttttcaggatataagcattaatacgtgtgtaatactgtaatttctttaaaagtgtaatttggggcatggttaaaccacagaggtgtctatgaatttgattttgactcccaactgcagtggcagtagtgtgtgcctttctcttccagagcaataagcattttgctgaggaacttaaaatttgcatctaggaaattgaatctcctaggctagtctttgatcacacaaatctaaactaaagacggacacagtacaaaacaaaaacaaaaacagaacaagtggttcagcctcaatcttcatttttttctgtgtatgattacgagcgaagtagaggtacatcacaacaccacaatcatttattgaatagtgtacattaccccaacatccttattcataatgactttaagatttaataaagggaattagaggaatatacaaacgtatatgacagttaggtacttcacctctaaaaaaaaacaataaaaagtgtgtattcaagggagggagaaaagacatttctttaaggggactgggaacactttgggcatttgttgaatgcccataatattactttaaaaatgcccctcctattcaacatagtattgggagttctggccggggcaatcagacaagagaaagaaataaaggaagagaggaagtcaaattgtctctgtttgcagatgacatgattgtatatttagaaaactccaacatctcagtccaaaatctccttaagctgataagcaacttcagcaaagtctcaggacacaaaatcaatgtgcaaaaatcacaagcttttctatacacaaataacagacaaacagagagccaaaccatgagtgaattcccattcacaattgctactaagagaataaaatacctaggaatacaacttacaaggaatgtgaaggacctcttcaaggaaaactgcaaaccactgctctaggaaatagagaggacacaaacaaataacaaaaaattccatgctcatagataggaagaatcaatattgtgaaaatgatcatactgctcaaagtaatttatagattcaatgctatccccatcaagctaccagtgactttcttcacagaattagaaaaaaccgctttaaatttcatatggaaccaaagagcctgcatagccaagacaatcctaagcaaaaagaataaagctggaggcattaagatccctgatttcaaactatactacaaggctatggtaaccaaaacagcatggtactggtaccaaaacagatacatagaccaatggaacagaacagaggccacagatacaataccactcatctacaaccatctgatctttgacaaacccgacacaaacaagcaatgggaaaaggattccctatttaactttgttgttgggaaaactggttagccatatgcagaaaactgaaactggaccccttccttacactttatacaaaaattaactcaagatggattaaatacttaaacataacacgtaaaaccataaaaatcctagaagaaaacctaggcaataccattcaggacataggtgtggggaaatacttcatgtctaaaacaccaaaagcaatggcaacaaaagccaaaataggcaaatgggatctaattaaactaaagagcttctgcacagcaaaagaaactatcttcagactaaataggcaacctacagaatgggagaaaatttttgcaatctgtccatctgacaaagcgctaatatccagaatctacaaagaacttaaacaaatttacaagaaaacaacaaacaatcccatcaaaaagtggacagaggatatgaacagacacgccataaaaaaggatgagttcatgtcctttgaagggacatggatgaagctggaagccatcatgctcagcaaactaacacaagaacagaaaaaccaaacaccacgttctcactcgtaagtgggagctgaacaatgagaacacatggacacagggcggggaacatcacacgccggcgcctgtcggggtgttttgggggctaggggagggacagcattacaagaaatacctaatgtaggtgatgggttgatgggtgcagcaaaccagcatggcatgtgcataactatgtaacaaactgcacgttctgcacatgtaccacagaacttaaagtataataaacaagaaaaaagaaaaaaatacaattaatttcaggatatgattttaatgaatagcaactagtaacagaggttttaaacatgacaaagggagaattttcctggggaaacatttcatacccaaactctatcttcccctttaaacatgtcaaaggggaagatacagaatgtataaaagaaaagtgccagatattttcacagagcagcactaaatctataattgtaagaaatataaggaaaataataggtgataaagctaaaaataaacattaagaacatactactgaaggccatacatgccagggtgaataatgtgtatttaatatggaaggaacaaaaacattggatttttgtagtctagaaaattaatatagaaatattgtgtataaaatgataaagggaaaagcaagatgtatggatatcaagattgactataataagagaaaaaacaggaattaaactagtttgttaaaattataatgaagggaatggtaagctaaatattttgttactgtgagcaatataatttggaaacataaatatagaaatacaaaatcaaagatgatacagaaattctgattgctaatgcatgggagaacgagcacacccttaacataaaaaagaagataagttggcttctagaaatatgactagggatgggtgcaggagggcatgttctatttttgaacattagaggtcctcaccccaccccccaatattttactatttttattaatcctatagtgcacatattggacataaatcatgttcctcacttatgatgatatctctgggataggttcctagagataaaatcatgctttcaaagactttctttccctacgcattgtcatattctttaccaaaatagttgtatcatcttcagcaatatatgagggagtattgctaactatattctcattaaacttgataattaacatgtctcttgagttttaccagttttagtaaaaatgaaattttgttaatttcatttgaatttctttgtttacaagtggaatcaaatgttaaaataggttatttagattttatattttcctttctggaaattgtttatccaggtattttaccatatatattcacctgccatttgtttctataggccttattgagtttttctttctaactaattgaaaagaatatatctgtttgttgacttttaaatgaatatttgctgcaagttttcattaatttttatttgcttttttcttttcttttcttttttttttttttttttttttttgagacagagtcttgctgtgtcgccaccctggagtgcagtggcgcgaccttggctcactgcagcctctgcctcctgggttcaagcgattttcctgcctcagcctcccgagtagctgggactacagtcacgcaccaccacgtccagctaatttttatatttttagtagagatccgatttccccatgttggtcaggctggtctcgatctcttgacctcatgatccgccctccttggcctcccaaattgctaaaaattacaggtgtgagccaccgcatccggcctttatttgctttataattgtgttcatagttttaatgtatacatatatatatatatgtagttttgaagtgtccaagggaatctgaaggaaaatgcatttttttaaactggctgacatacaggaaggaagacatccttcaaagaaactgcttcaaagcaattacacagggaggaggttttataaaatttgggaggatgagccactctgaggaaaagcagaagaaatcctgagaatgaaaaacagcaaattttatgcattctggcatgcacattttcagcaaataggatgtttttggtgtgaggaagaccaaaagaatctcataacttcctttaggaaggttatgatcactcacttctcagggataaatgacattttccagctggggtcaatcaggagtggggaaaatgtcatgggaatagagggatctaaaatcattcagaaaaaaaatcttacagaagtcaagtcaaaccaaactatcttttcctttatcgtttccagtattctctatctgggaaatctcccggctcaagttaatatctgtatatacattttttctttttttacgactcacatgtggcacattttttagaataggatgcatggagttggtcataagtgacttttcaaataggtgaccaacagatttgtggtaggtagaataataagtacactatcttcccaaaattttcttcttcatcttcagaacctataaatatgtgattttcatatcaaaaagaacctgcaaaatgttgactcaggatacagaccttgagagagatcatctgaatgggaccagtctaatcatatgagttcttaaaagcaaagaaaatgtcccagctggatcaagagaagagaaacaagaagaacttgacctactgttgctggttttgaagatggaagaaggaaccatgttccaagcaatgtgctagatgttgggaacagccctcagctgacagccagccaaataattgggacctctgtcctattgtaagatactgaattctgccaataattcaaataagctaggaaatttattttcccctagactttccaaaaaggagcagagccttgcagacaccttgattttagccctgtgagaactgtgttagaggtctaacctacagaactgtgagagaataaatttgttttgttttaaggggttaactttttggtaatttattccagcagcaatggaaatccaatacggcatacaacattattttttgaataatcttttcatttttaatgggtttaatgtctaccatttattaaagtcttttatctattatggctgtcctggagaatcaaggaacctgggggttagaagagatatgagtgacctggaaagtagatagaaaactgaattagattgtttcaagaagtacagggaattaatgagcagggtgttatagtgagcacctgtagtcctggctactcagtgggctgagccaggaggataacttgagcccaggattttgaggctgtagtgagctatgatcatataatttagtcagtattgaggaagtagaggttacactctaaattatacagtgaaatgaaaggtgatgacatgtaagttgagaaggagtctgagttctggaaggagtaagtttgggggcatggaaaaatcagagcaatcaccaaaacaggaaagatataagattcagaaagaagataaaataattgatagtgaggaaaaaattatatagtatttacttttcttttgagactttatcttctgtttcccttctgttctttctgccttccttctcatcctactttccactgtagaattttgtcttgaattttgatccatggcaatctataaaagaaaacactaataacgttcttaaattcagagagaatttttcctatctctgagagcagttgtaaagcgtgaatttgtctccaaagtggtttgcattctttctataaggatgctaaatgtaaacaaagtactgctattagaatgatatatgtgaggctccccatgcaccttggcagaaaaatgttatataaatggaaagtgtcgcatatattttaaaagaatgcatgagtttattcctcaaggggagttgctaatttatgtactgtgcttgttctaaaggtacgtgcatgattcataagttagtttataagtaattttgtactggagaaagagagctaagaggatacttaactgtttccaagtatctgaaagacttattttatgataatcaactattcaccattttattgtagagaagaaggaaatcaatttaaatttcacctgtaaaagtttgtgcaaaatataaatcttatgtaagcatcctgatttgttgtggactttaagaatacaaaataaatactctttttattttgttttctaattcttatgcccctaaattctctgttcttcatatccacactcctgaattttaccaaatagttttaaaaacattaaccattcccctgctgtaaatttttcctcttgttagtctttttttaaatctaaaaaaaaagacaattagttttattttataagccatctatacctctatcatggctacctaatatctggggttaaatatgtaccatgttcagacagtacgggcataaatacacacagtgtccaacggaacaaaatagagaactcaaaaataaattcacgcatttacagtcaattcatttttgacaagggtaccaagaacatgcactggagaaagcatagtctctttgataaatggtgctgggaagcctggatatccgcacgcagaataataaaattagacccttatgtctcacagtatacaaaaactaaatcaaaatggattagatttaatctaagacatcaaactataaaactactaggaaaaagactggggaaacattccaggacgttggtctaggcaaagatttcttgaggaagatctcaaaaacggagggaaccaaagcaaaaactgacaggtggaatcacatcaagttaaaaagcttctgtacagaaaaagaaatcatcaagaaagtgagagacaacccacagaataggaaaaaatatttgcaaactacccatctgacaagcgattaataaacagaatatatagggagtttaaacaactcaatatgaaaaaataataataatccaatttaaaagggacaaaagatctaaatagacatttagatcaaaagaagacatacaaatggccaagagacatataagaaatggtcaacatcactaatcataagggaaatgcaaattgaagctacagtgatatattgtctcacagcagttacgatggcttttatccaaaagacaggcaattgtgaatgctggcgaggatgtgaagaaaggggaaccctcatacactgttggtgagaatgtaaattagtatagccatatggagagtagtgtggaggttcctcgaaaaactaaaaatgaagttaccacatgatcctgcaatctcactgctaggtatatatccaaaataatggaaatcaatttatggaagggatttctgcacacttgtgtttattgcaacactattcacaatagctaagatatagaatccacctaagtatccatcaacagatgaatggataaagaaaatgtggttcatatatacaatagagtatattcagccattataaaaaaatgaaatcctgtcatttgcaacaacatgttaagcgaaataagccaggcacagaaagataaatatcacatgttttcatgtgggagcaaaaaaaaaaactgatctcatggaggtagggagtagaatgatggttaccagaagtttggaagggtcgggcagagagggtgataaagagacagttaatgtgtacaaaaagacaattagatatttgggataaaatttagtatttggtagcataatagaggataattatcaagaatttgttgtatatttcaaaataactaagagtggaattaggatgtctctaacacaaaaaaagataaatgcttgaggtgatgaataccccaactacctcgatttgatcatcactcattgtatgcttgttcatacatgttatactttgatacatagaactagtatgatacgtacaactagtatgtatcaaactcatgtatacatactcattgtatgcatcaaaatataacatgtaccctataaatatttccaactattgtatatccataataattaaaaataaaagttaaagaaaatatatatgtaccatgctcatgaaagtttgaataaatcacaaagttacttgaaagtaacaccttatatgtgtgtatatctctgtaatattttaagtaacagacttttaaaatattatttgtagagctaattctaatgggcatgagatgagttgtttttattttttgctttttgttttgttttggttcaaaactatcaacttttccttaaaaaggcaaaaggtttagactttttaaagaaacttgtataatacctagattatttttgagagtctcattcttgtcatactttcatgattctcattcctgcttttttcttctgacacaattaaaaaatactaagaaaagtattctctccaagaaggaaggccattattttttattccaaagtaatgatctccttcatgccctcttcactctgcccttgcagtcattagtttaatacgcaaatagaagtgagctgcctaggcatattgcaagagttaatgaccaactaattgttaccaacaccacaatcccctcccatgaaaatacagatactgtgaattgatgactagaatctccatatgtttaatgggaaaataacaggaggctccgttgtactagtgacaaaacatgagggaaaaaataattttcatcacgtgcccctgatttaaaattgcttcaggccatccttgtttcacagctaggagtataataaattaagaaaaagtagtatagggctgagatgaaaccctgtgggatatgtgagtgaactaacaggtagagaaattgaagggaaaaagaaaaaaacgtggatagccttgggtggataatacaagaagcaagaaaatagtgtcaagatgcagcagtaataagctaataacttacagatgtaatatacgttgctacaggtctctcaacttcatgtgtttcatactttaagagtttctgtgaccaagtagaggcttgataaagctgaactttatctattaataaaaaatacatgccactcattagggggcagttcatagtgcagcagaaggcatggtggggactaagaatgagaaagggaagcaagagacaagcaacatttactgagagccaagcattaggcatgtgatactcatttataatctactgttttgcctataaggtaaaatgtatgatttttcattacaggtaaggaaacgagtttggatatatatatatttttccctaaactttgttgacacatttgttcattcatccatttaacaaacgcttatatttaggtaagacttcttgaaaaaaaaatcaaattctgaaataagacaaaaatgtaaatgatttttttcaatatcaggtatggatataagctcatccaaatattaggtaatgtatagtaaatcatttttttcattaaatataggcccatacgtagtgaattgacatattaaattgtaaatgttgctgggcatggtggctcatgtctgtaatttcagcactttggttggctgagggaggtggatcacctgaggtcaggagtttgagaccagcctggccaacatagtgaaaccccatctgtacaaaaaataaaaaaattagccaggcatggtggcacatgcctttaatcccagctactctggaggctgaggtaggagaatctcttgaacccaggaggcagaggttgcagtgagccgagactgtgcctctgcactccagcctggacaacagagtgagattctgtctcaaaaaaaaaaaaaaaatgtaaatgtttgtttggtaaacgtatgcataactgactagtggtaagcatagaagataacggtttattcccctgttggatgttaatcaggtccatatttaacccatcattcttatcctaacatacctttattaaatagtctagaaaaacccatctcttcaaatattttcagaaccagttttaacatcttcttttcttattagtcatgaattgaataatatttttgagacattttatatttgcaagagaagtaaaaatgagtacaaagacaaataagccacaataagacaaatagccacaataagacaataagccacaataagacaaacacctttcccctgtgttcttgatagggaaaactgatacttatgcaactactaaccgcaaataaagagtagagttaagaggaaggtagaagcagtggagacaaaattgttataatacaaatttgacttgagatgaatcttgacagacgaaaaggttttcactaggcaaatagcaatttggaagggctttctcaaaagagacaaaaagtattataggtgacagagggagcacttaaactagatctgcttggctcctagacacatatttttttccatcatgctttgttctttttcatcctttgtggaagactttaatttctagtaatcatctttagcctctctggtcatgacatcccttatctaataaacaaagtcattatgctgaagatatataacatatttatgataactaaagtttcttcttattatgatatccattaattacacagtaataataattagcttttggttattaccttaagaacattaaaaaataatgcaaatacattcctaatgcacattttcttgtatttatgtatagatacacaatagaaaacccatttcttgtgacttgtaagtttgaatcagtttcttccccccctcaaaaaaaattcagtatgtataatagatgatgttcagttttaaatcattgtgccttttgaatttagttcaggtctaaaactagtagaaatagatacttatgttaataaaaaaattgttgttaaagggtggcatatcttctgcgtctctttacgcacccatcaaacctattctttttttaatctcttaaatttaaatctgtatattgggagactgatttatttttgtgaaggaacaaaagacagaggatggcagcaccatactgattttgccttgtttatgaaatgtcaccatgttacatgttgttcaccatcttatctagctatgaggtggttaggaagaatgatgtattaggttcatattaaattaacaacatgtcaagtttcttacttctatactcttggagcaacacttactttttcctcttgacacatatcaaaaatcttaattttccattcattatatggctatttggttaagagctgcctccctcaggaagactattgagtttcttcaggatagaagaatgactgaatgaccggcatgattatgcatacaaagagtgtttgaataaataaacaaattaataaatggatgactaataaatatattaaaatatcaagacatatgtgtatatataatttaaaatcaaaaaacaaaatatttgtaagtaattcagtctcttgtgttatctctctcactctatgtcccatggcattacatgacatgttttattttatattataaggtaaatgttctggagacttttagaagcccatcattttttttctatgcattctgttatttcagacaaaatgttaagtgttgacatttctcttacaagagatagttattaaaatctaaattctaaacactcctgttaaacttttaacatcaacctaattgcactgtcaatggtatatgtcttcctttaatcttactgagtctgttctttgcgcctggataccaattatcaatttgttttggccttcacgcatgctcttcctttctgaatgaatcaagactcacaacttcctaatattcaaaatacattgaggattttccaaatactttacttaattgttcactcattctatctttcatttgttcaacaccattataaaacacccaaaaagttgtttgtgatgttgtcctgaacattgtcaaggttctacagataaattagatacaatccttggtttatgaaacttataaactcgtagttacaataaagtaatcaaatatataataaaattaaaatggagtttctaaattatcaaattagtaggatatacttgcatgttttaattataataccattttcttctacaaatattgtactatatgtacatttcatatagctaatatgtaagtgtgaatgaaatgatacacttctaactttaaatttcctggggagatttgaatacacaatcaaagctctccaaaagcatcaaaatgagatgataatttttgtattgcttttaatgtaccttttatctttagtgtattaaatattttttgtgtctgtcaatgcacatctgtaacatcattttcaatggatggtcacatcatagacgttttaaagcaacccttgtctgttggaaattaatttccttttcaatttctcattattacaaaaaaaatactgtgattgacaatctagacaatgaagatattttaaaacatctaatctaaagtaatttatccaacaaatattggttgttcgcctactatgtgtacattctcctataaagctttgaagagttaaatctctttatactctctcttccttcaccctttccctctctgtctatccttatcccctgctctgtctatctctatctgtatttgtctgtctgtctatgtcagtgtctgtaatattgtggtgtagggacttgtaacatatatggaataagacaaatatttaggaaatggtggttgaatatgtctacatatcagtattttccctattttctttccttgcttccttccctccttccttattccttctttcttttgtatttttctttgcctttcttctatatttttcttaagtattttcattagtgttgttgctttaaatgtatattacacttataataaaattagttttcaaaattaggaaaagctcagatcttctgatgctttttaaatagaggaggagacagaacgtgcacataacacatttgtttactatgaatttgtaacatccatattccctacttttttagtggcttacaaattatactatttttaattaaaatttttaattaaaatgatagaatacctcccaagaacaatgttagactgaattctgacttcatgattatgttttgagatttttgatcattagataattttacaatttaaaatctagttaactaaattctcaggctgggcgtggtggctcaggcctgcaatctcagcactttgggaagccgaggtggtcagatcacttgaggtcaagagttcgagaacagcctggccaacatggtgaaacctcgcctctactgaaaatacaaaaattagtcgagcgtggtggtgggcgcctgtaatcccagctacttgggaggctgaggcaggagaatcacttgaactcaggaggtgcaggttgcaatgagccgagatcgtgccactgcactccatccatcctggatgacaaagtatccttcctgcctccctccctcccttccttccttcttttcttccttccttccttccgttcttccttccttccgtccctctttccttattccttctttccttattttctttgcctttcttctatatttttcttttgtattttcgtttttgttgttgctttaaatgtatattacacttataataaaattagttttcaaaattaggaaaagctcagatcttctgatgctttttggacaaaattggagacagaattgcacgtaacacatttgtttactttgaatttgttacatccaaattctgctaaaagactggagatattgtgtctatacatttggaagccaaatatgagatagcagagagtggtgaaatcacccttgaaatgagaattataaaactggaaacaagacctagttgtatctttactggctaggggatcttgggctgcttcagttagtgaaaagaacaccagtttggcatcacaatgcctgacttaacctgctggccccaatatatattcgttgtgtgacactagacaccatttaagtttgcttatcttcaatttcctcagtataaaagaagaaaaaatgattattatgttcataccgttaagttaaagttatataatatgtgtcacactgcaaataaagtatattaattatgtgcataaacccacttattactcactaaacaataaaaaaactaccaaaaaactaacgtttttattgcataaatataaatataaccttaagatttactgtgatcttgtacaagtgtatataaaatcaaacactagacatctcttttagagagttttatttttcagtgtctgtgcttatcttaaatgagtactatttagattataatttaagcagtatggatgtcagtggttgaagttcatttcattttatacattacataatgtgtcattaataggaagcacttattcttaactatgatttttcttgtctcttacgagaactcagaatttgaaaacctgtgaaagtaatctaaatattcttcccattgcaggaggcttttgtgcattactgctgggtgatggtctttcattgattctatgaacttgccaagcataggaattctgtttactgtttttctgcccaatatggtagtaaatcactccaagagttggtaaaatgactgcatattgggaagttctgtaccatcagttttttcagcaatcatctgagggatcaaaacagatctgattcaccagagactaccttaaaaaaccagaatggcagttgatttaaaattgaagatatatgtggcctaagatgcagaactatttgtcttcacagggcataaaccttctagtgggaaaatccattccatttatcaaattataggccagaagtttattttgcgagcaaagggatttgagggttttaaggggtatttctatgttctctagcaaagagagctcctttactctgaggatatttcttcctaaagaagtaggactcagtttctaagatctgtgcagtctttcccactatataatctgatacaaaaacgttactaatgtttgaatgtttcttaattgttgctacaagtttgctttttacatgaccatatttattagcctgttcacaggctgctaataaagacatatccgagactgggtaatttataaaggaaagaggttcaatggactcacagttccacatggctgggggaggcctcacaatcatggcagaagaggaaggaagaacaaaaggacatcttacaagagagtgtgtgcaggagatctgccctttataaaaccatcagatctcatgagacttattcactatcacaagaacagcatgggaaagacctgccccccatgattcaattacctcccaccgggtactcccactacacttgggaattatgggatctaccattcaagatgagatttgggtggggacacagccaaccatatcactacatgaatacactgaaacccacccaatccacccaatttatttccactacactacatcaaaagagatagtgtacaaaaggatgctggtttttgtggcctgccaaatttgaggcaaaatcatgacagtggttcatctgaccaccgtcttcttttcttggtaatgtactgaaacttcttaattctcaaaactaagagtaatttctgtaaatgagaaactgaaaatattacttgaaagagtttcaaggaagttggattctattcccagtttcatcgctgaggagcatatcactttagctttttgagtcctagttttcacttctgtaaaatgagaagacagagtgggttgaattctaaaatcagttgtagggctaagatgatgacttaccatgctacagtttggggtagtttcttattgatatgaataatattttgtgcattatttacattaaaaatttttattgttttcagaaccaaatgacctttttctctaaaaaaatacatatttttagatatttcttgctttatgggtcacaaaatgtagccacaataatcagaaaaggaccaatattgttgacaaagtgaacaactaagaaatgtaatacttgagccccagagctggcttttaacttaaatagtaaatttctaaattttgattactataaataatattatcactataattatcttccacaacagggaagaccacagtggctctgaagaactaaataaaacctagatatcacacatatttgagagaacaaaaattcacaataggaagctgtacaatatttgggaattcttttcacagtttaaactttctctgtcttcaaatatccctattacagcaaaatcccacctactcacaattgtacgtattcaaaatgggacctcagaacacaagcaggtggaaatcacaggtcatggccacagttgaaatgatatgtctttgctaatttaaaaacacactcttgtgatgagcagttttgcatatttaatataaatattacatcaaaaatagattgtgcttgctctgcaatgttgcccttataagccctggagggatgtgatcattttctgctgactctgctatatatgacggtttgtaaattaatactaaccttctcaatggtaaatgttggcccagccctacagtaattatgtaacgcagaaaacttgagcaatcagacatgtttcaatggtaaatattttgtctctccccacccccggtattatgtattaacgaatacattattacctgctcaagcattttctcttttctgtctcaatcagtattatggtccgtgatataattaaatgtttcattttgaacaaaaacatttattttattgctcaccaaggctgttcaattttagcctttggccatatgactttaatcagaagtatttgtgatttagagcactatagcatgtttatttttgcaatttattttaacagcccatgggaaaatgacagtaaatagcttgtaatttttgtaagtaataaaaaaatagctgtgacctatgattgaaggaaaaaaaaattcagggactttcctgtagaaatagactgtcatcgtttgaaaactcaacattttctaaattactatttatttttaatgatcaaaggcttcttacacattgtctcttccagtgattctcaaagtgttatacttagactactgcatgataataaattggaaaatgtctttaaaaaatagatttctttgccagacgcagtggctcacacctgtaattcaagcactttgagaggacgaggcaggagaatcacttgcgctcaggaattcgagaccagcctgggcaacaatatgagaccctgtctctgcaaaaaatacaaaaattagccaagcgtgctggcacatgcctatagtcctagctacttgagaggctgagacaggaggattgcttgagcccaggagacagaggttgcagagagctatgattgcaccactgcaccccagcctgagcaaaagagcaagaccctgtctccaataatagtagtagtaataataataatgatggatttgttggcactacccagaattattgaataagaaaattttgtgagcagaatctcaggctctgcattttgtataagcttaccagctaattcttttgaatatttaagtttgcattatcctattttaaaattctattttttcatataaactgcaatcatgagaaaatataggactttttccccaatctcacaagttaactgcagaatttgaatgagaattcagatctctttattcctaagacaatttctagagacaatacatactggatttcaatttatttttcatcctacacagttggtataaaattaattttataaataagaaccttttatattactaggataaaagtagcattctaacaatttttcatctttaggttggtgtctcacctacttatgtaaactttttctagcttaatcagtctaatatatcattctttttttttctgagacaaagttctaaactcatgacatccgatcacgtgttcccgtctcaaaattacttgttttgctctcatttgtgtatttcccatttgtattaatcaagatatactaggttatgctgcattaacaaatgaacatgccaaagtcacagtggcatagtgcagtcagtgaaagtttatttttcagccatactacatatccagcatggctcagcagggatctctgctccattctgatgctattagtgctattaagcaaatattactggtccggccccctctgacacatggtaaaattacacatgcatgctttttttgcaattacattgggcaattaattagttcttccagatatcctgtaagcagaagttgcaggcattgcactgcaacatttaattgctggtgtgagaacctccagacatcatctctctggcattacaattggtaacattgaaaatggtaactattccttcagtgtgcatctttgaggtaccataaggagcagagatttgcctcagattcacaagagatatattgtacaagagaaaaataaagttgtgttgttttgtcttctgagattgttagaattgtttgttaccttcgcataacattgactatctggactcagatatcctcagaaatatatatacagagagatccagcatggaagaggctgtgcttccttgtatctgcaatattttaaacatgtggcgtttttgtccccatgacatagaaaatgtctgaaaaagtttacacagctttttcattcctcaagctaacaataataggatatttttcctcacagcccgttatccagaactaatcacatgactccaacatactaaaagaagggtaataaatgcaatttttaattttgggagaggaaaagaagaacttgatattaataaaaactagtaatggggtagacttcattgaataaactttatatttttgttcatagaaaattttccctcatatataatttggaagtcaagaacaaatttgttgacttgggataatatcaagaagtcataatggaatatgcagatatatgtgcctgtaataaaataaagtcctaaaaagaaaaaataataaatagatttttaaagcatggtaaatatatttgcatattatgacagaggtcaacacccttactctattaaaaatatttacaaatcaatgtttaaataatggaaacgtaatcatataaaaccaggaaaaaaagtgaatagtcactcaaatcgtaatatgaatacccaaatctagtaaacctctgaaaaaaatgttcactgttattcttctcaaaaaatgaaaatttaaaaatcaagtatatattctgcctaccaattgtcaaaaacattttgaaatatattaatagcaagaggcagacttgaagggagcaaacttccctagaacatctataagtagttaggggatcaattttaaaacgtttatgaaaattaaaaatagaaaatatatcccagggaaacattcaaaaagtatacaaagatatatatttgagaatattcactgtagcagcattttcaaaactaaaaatttagaaatgtttgtaaataggagatagttcagtaaatcatggtacagaaagacagtggaattctgttacagatagaaagcaaaataaacacaggactttcagttaggagcatgttgggtatatgtgagaaaaaaatgtcagtgaggtcatgacatacttggctagagagagaaaaatgagaggttcggtgatgaaggttaaatcatagatggtttgtaggccaacataagaacttagagcttcactcaaatttgagcctttttgatgaatttgaccaaaagagtaaaattacttggatgaccacttgtaaggatctctctacctattttgtggtgaattgattaaaatgaaaataatataagcagggagaccaggtagatgactatttcctgaagcaaaataagagatgttggtaacttgggataggataatagtaatgaaaaatatggaataattttaaggttaaaaaattaagatttgctgatggactagatacagtgagtgagagaaggaaaggtattaaaaagtaatccaagtctaccttgatcaagtgaaaggctgcattgaaaagacagaaagaagtaggtttatgagaaaatcaaaaatttacttcggagcatattaaagttgagttgcctattttgcatcaaatggagatgtaaatgaagcagttgggtatacaaacgtgagtgaagagatacattttagaagcatcagtgcataaattttattaaaggctttttaaagtaatgaccttgaaagatcatctatagtgagtaagtagacagagacagaaggcatctatggatcaagtcctggagtaatccaataggtagagcttgcaagatgaggcagagctagctagtaatagagaaaagaagtaatttttgagattcaaaaaaaaaaaaaaaaatgaaagagtggcatccagaagccaagtgaaggtatttaaagggggattttaatcaactctatcaaatacaatttatagtcaaataagatggctgaaaattgacaacatgagttggcagtatgactattattggtagcatttgtatgaacgtctcatgatggaaaatgaaagtctaattgaaatgactttgagacaatggaagaaaaggacacaaaaagagtgagacgattttctgtatgcaagcagaggctgaatagtagacagcagggtatatgagatgaaggtaggtttttatatgatagatattatagcttgcttatatgctgatgacaaaaatccagtaaagtaggaaaattaaggttacataaaatagaaaaaatagtaaccaggagagggtgagacaagggctcttgtttgtttatttcaactgaggagtcaaatttctttcatttttaagaataagtacagcattgtacttcaagagcaaaaaataaagagcaaggtaccatggtgaagaaaggtggggcaggagggggaaagaaggtgaaagataatttataccattttttgctaataatttttatattatctaatttagtctttatttttactttttgaacagaattttttaaaaacagttttagagtgacagaaaaattgggcagaaagtacagagaatttttgtatgcttcccgctcccacacacatagcatcttcctctatcaatattttgcaccagagtgacacattttttacaattaaaaacctacattaacacgtcaatgttactcaaagtctatagcttacattagggtacactcttggtgtcatacattctatgggttttgacaaatgtataatggcatgtatctataaataaatttttattatcaaagtatcataaataataactatgataaaaatattttatcataaagtatcataaataataattttattaccctaaaaatcctctgtgctctagtcatccctccatccccacccaatgcctgaaaaccattgattgtcttattgtcctgcaattttttctataattttattgtggtataataaacaacataaaattcgctttcttaacaattttaagtttacagttcggtggtattaaatatactcataatgttgtgcaacattcaccaccgttcatctctataattcttttcctcttttaaaacttaaattctgttatacacactaaacaataattttctatgcactcatcctgaagcccctcaccaacactattctaatttctgtctctatgattttgactgctatcagtatacttcttataagcaaaacctatagtatcattctttatatgactggattatttcacatagcaaaatgcccttaagatgtatccaagttttagcatgtatcagaattttctccttttttaaatgctaaataacattccattatacccatacatcacattttctttgggtttaggtatatctctcatagacagaccatgtgtttttaactattctgtcaatctctgtttttacattccatttacatttaaagtaattactgaaacgaggaggggcttctgtgtttttgctctttgttttctatatacgttatagctgttttgttcctcatttccagaattattgtcttacattgtgtttagctgatttcttacagcgaaatatttaaaatcctttcttatttccttttatgtatattatatccctattttccttgtggttaccatgggaattacatttaacggcctaaagttataacactctcattttgtttatgccgacttaagtaacataggaaaccctttaccacttaatggccctgttgccactccttttggttgttgatgtgacaaaattacatctttatacatccggtgccccaaaacataaactgataattcttttaaatacattggtctcttaaaatatgtggaaaacaaaatgttgtgttacaaaccaaagttacaattattctagcttttagattaataactgtttatttttaaatgtagtagtctcttaaatcatgtagaaaacaaaaagtaaagttacaacttactgttgtaagtaaagttacaaattattgttgttacaataatactagcttttgtaattgcccatgtatttacctttatagaggtatttatctcttcacatgactttgaattactgtctactctcctttcatttcaccctatggaacccacttaagcatatcttgcaaagtaggtctagtggaaacaaattccctcagattttatctgggaatctcagtttcaccctcacttttgaaggatggttttgtcagatttagaattcttcgctaacaatttgaaaatattttttcagcacattaagtatcttggtccactaacttctgccctacaaagtttctgatgagaaataagtggataatgttactgaggattccttgtgtataagtcacttctctgttgctacttgaaagattttctccttgtttttggcttttaaaagtttgattttaatgtgtctatgtgtgggtctctttatttttattctctttgaagtttgagattcttggatacttacattcatatgagaagttttcagcaattatttcttcaaataatttctctttctgtctctcttgctcgctcactcactctctctgtcttctgggacttctacaatgcatatgttaatttatttgttggtttcccagatatcatttaggttctgttcatatttattcaatatttttgttcctgtttttcagaatcaatatttattgttgtatcttcaagtttgctgattttttcttttgcttacacaaatttgcctttgaatccctctgtaaattttccatttcaaatactgtacttttcagctccagaactttaggttcagaatttctttttttctatctctttattgataattacattttgctgttaggtagttttcttgactttatctatatcttcctttagttctatatcttccttaacatctttaagatggacattttgaagttttgtctatggatctgccatcaagtctttttgggtatagtgtcggttgatttttttttcctttgaaaggccatgctttcttgtttctttgtgtgttttgtgttgttgtaaaaaatggatacttgaatctaataatgtggtaaccctggtaatctgacccttcccccttcctcagagtttgtcagtttttgatattctttttatttatcgttttgctttttgtattgttgtaggctatctctcattctgggatcagcctgaggtaaaataataaattcttgtcaagtcttttctgaatctatgccttttccttaacatgcacagtcactttttaatgttccccaatatatacaattgcttttaaatatatcagtgtttaatgcctggctctcaaaagagaaaaaagaaaaaaaaattaaaaaattagttggagaagcactggaaagtcacttcagccagaggtaaaggggctttcaacaatggcgagacgtgaaaaatcaatggcagctcgtggcttgtctgcacctctctgataagaagcagctgtcagaagaacaaccccaaatatctggaggacagagtcctttgtgctcaccctggctccttacagttctgtccagtctgcttcaggaacatatgcatagctgtctaccacagcgatgtatgcggagaatgggtagcaggtgctgtactgagtgctaaacttgatggaagttaactgcaattttccatcccagcattcccctggaagttgcaaactttcaatagactccagggttccaaagagttacatcagacagattctgccagtgctattgttatctaggtggggagacagattcctggtgcttcctacgccaccactttttcagaatcctctggaatgaactcctttgcagaagcaaagaagttggtctttgttgagactacagacaaataatccataatagtagtactggttatagagtgtatgggttacagttactgacaaattttgagaagttgttattgatgctaatggagtactcttctacctgattctatttcctcagtaaaatgagaagcagttttttagctgaggatgagaagagggtttgaaacagaaagaaaaacagagattgaaaaaggagttgaggatttatgcaaatgagaaattatattgttgaaccttggaacagcaaaagtcactaggatcaatagataataggtcctgtgaggttgaaagatcactgaagctggatagataagaaacgaagactgaaaaatggaatacttgaaattaagattatgaagcagatgcagttattgacagtaaaacatctaggttatggtcatgagagtgggtgactaagacagcatgggaggcaaaattatgaaaggacagaaggaccaggaaatgagacaacaggattctaaaatggctgcacatatttttaaaatcaccaagaattataacagaagttggggttgagagagtaacagtaggcccatgtgctataaccctcaacaatgtggaagagaaaacccaagggggtgccactgagtaaaacaaggaagggaggcagttgtagaatgtgatgacatgagctacaaaagggcatttgtagggagctgcaagaaatcatggcctgaaaggagcattgaaaagcaaagagactatattccacgttcaggaccagggaatgggagaaaaaaattcacaacttagagagggtcacaggcaaagccacgtcttcggggaagagctattattcaatcacagctaagtcgttagagggatgttcagaaaaacaaacaaacaaaaaacagaaaatatgagctaacttattggaactatgaattctacagggcagagcaagaacagaacagctttaggagtcaaggagagtgggaggtggggtcagactgaggttgtcagtgccatatggggaaaagggccctgcaacaactaacataaacagagatgtgggacatgattacatgagctctgatagtctgtgagacagagtgtggtagactggcaaatgtgtgttggaggggagggatggtggtgttactaggagcacacaatgatctggactgtcctcttttcactcttctctaggtttgtgaggaagctttggaaagggacagaatcagaactgtgggcatatccataccagaatattagcagtaaatatcccggcatggtggcattatgcatgacactgattttctcattttttatttagtatttttaagtacaattgtcctgctgtgtcagtagtgggttcttcatccatggattcaaccaaccgtgaatagaaaacattcggaaaaataatgccactgtactgaacacgtaccacacttttaaaattcctgtaattttctaaccaatacagtgtaacaactatttacataaaatctacattgtatcaggcgttataagtaatctagagaagacttaaagtatatggaagattgtttgtagtttatatgcaaatactacgctcttttatgtaagggacttgaacatccatggactctggtatctgtgggggtcctggaatcaatccctcacagatatctgtatttattttaagtgaatgtgtattatggaatataaatataaatatatgtatatgcacacacacacatatatatacacaatatatacacacatatatatacacaatataagtgtatatatatgtgtgtgtgttgtcatttttcaacttaagtttaaaaaattgcctagaagggataaaacaaaaatagagctccagatatctaatgttcttttcagaaagaaatctttatatctctgttttacttcagctgtattttttaaactacttggctaaagtaaacccacgttcatagagaaaatcactattattttgcataaagttgtgaagtctaaggctgaatagagtctaacaatcatatttattgatgtgtctgttgttaaacactgagcagatgtctccattagagcctctataatgatgtctagatcattttagggagatttttactaatttcaagctacatagtgattccttccacatcaaatttttacttcttagatatttcttgtatttcttatcccctaatatggagactattaggctctcattatttctttcccactcctcagggttatcaggaggattataagcatgagctctggaattagacttctagtgtttgaatcccattgatgtctaaaagatatggcctttgccctcataatttgcaatgtaatcattgaagagaggcaggtacatcagtttctacaacacaatgtagacagaagtaagtatcataaaaataatattggctgaattggtagaaaatatcatggagggaatggcttttgagtggggattgaataaacagagtgttttaggaataaaaatggtgttaggaagaaaagttcaagcaaagaataattttagtgaaggtataaaaatgatgaactgctctcatcttcaggggagggtctagaaggatgggagtaaatattgagtaggggaaaattgagagatgtggttaaaaataccttgtttggacatgaatactagcctaataattctgatttgctttactatccatttgactttatggatcattaaaaaattttagtataaatgctgatcgctggtatatatctctctaagcttgtttctgcacatgagagcaatcaggaaaacattttcaatcaatcacttattttactagctggtgccaggcaaatggctttcctgattttttttcaatctttaaaattgacttaacgactatttttttaagttaattgggtggttcagggtaagtttaaatgcaaacaaaacacttagcataggagagcgagtgcgtaaattcacagtgggagcaaacatcagggcaacaaaaaaattagagccatttttgagtcattgaccacccacatttgagagttttttcctggatgaacattccttctgcctttggaaataaattaatgttttagagcaggggttagcacactttttccatagagaaccagatagtaaatattttgggccttgctggataaatagtctctgtcacaggacttgtctctacttttatagggtgaaaacacctgtagacaatgtgtaaatgagtgggcatggttgtcttccatctaaacattatttacatagtgggtagtagatcatatctgagccacagtcatagctggctgaccctgtcttagaaaattattgggaacaggtgtgtaaaaagttgaagtaaacaaatgcaatattaagatactatcacataatgatgaatgttcaccaaatgttttctttgaatatcaatgcaaacctggcctgactttgatagtgatacttccaactaagggcggaatccatagtcagcaaaaattattattttttgtatgtcttttgctgttacagagcagaggaaacaattaattcaacttagattaaagaaaggcatagtttaataataaatagacctcacagaaacacaagcccagaaactaacatagagctgggtatcatgagatataaaaatgggagtaaaaatttaggacagtaccaggtacttatttcagcccatgggcaatcttatttttcttttagaaaaaaatcttttaaggctgggtagttggcttatgtctataatcccaaggcgggaggattgcttgaacccagtggttatcagcctgggcaacatggtgagaccttgtctccacaaaaatataaaaaattagctgcgtgtggtggtgcatgcctgcagttccagctactgggaagactgaggtgggaggattgcttgagcttgggagtcaaggctgcaatgagccatgatcgcaccactgcactccagcctaggcaacagagtgagaccctgtctcaaaacaaaacaaaacaaaaagaaaaaccctgtaagattaatgttgatattatccccatcttacaaataagaaaactgagtcacagaccactgctaaagaagtttctcttggccacagcttagaaaatattagagccagattttttatccagccagttcacctcaggagccagtaatcttagacgttgaccaactggtttaagtcaatttgctctttgaagtttgagctaaactgtgaaaacaactaggatttatctaatcatagtagctaacatctgtgaatcaatatatgccagggctttatacaaatcagctcctttaatcttcacaaccctacttaatggacgaaaaaaagagacactgtcaccgaaagtgatataaatgcaattggtagagccaggactctatcctggtgagtctgcccttagagagtataaacttaatctttagggcaagcaaaataatgttaaaaaacataatatatgatgtgcagagaccaggctgctgaaatcagcaagagactgatttgctaggcaaggtggttcccagattatggaaccagtgaaggaggataattttttaatataggaagcaactgagaaccactgtagagttgtcagtcaggaaggtttgcttgatagcagtaaacactggagactgtaagggagtttgaaaaatgagggatccaaaagcaatcatgagttttgtgttatcctgcagaagagtgagagtagtaagaaactgagaagagagaattacttggagacatatttcaaaggaaaatattatttgacactgacaggtcacagaagataaagcaaaaaatagtcaagattaattcacatgcttagcctgggataccctgacaaatgatgttatcacagacaaactgaataagtttagttaaagaagccagtttgaattaaaagtaagtttggttaaattcactcgtaaatttaaagagatatgccattttggcaattacaaatctagagatggagtacagttcatagagcataaagagtgagaaaagccattcagtttagaggtgagaacaccatcagttacgtatgtctacaagagtaaattcaacagagtggtgtgaattgaaggtcatttggtggggatgaaataggttaacaatttgaaaccataacataatgagtttgcatggagtaataatgctcatgttagatttcaaggaattaataaaaacggcaaatggaaatacagttagcaggaacctagatcatgtagcacacatttcagaacctgtccataacagaaggaaactgcagtggtgactctaggacaaataggtagttttcctttcttttttaaagttggtgaagacctagtttttccttattgtatatttagttttcctcctatagctccaaggtaaaatatataagtgctatttgtttcctagcaatatttttcccagaagcagaatgataagttgtagaagagatatattttaattatttattgaaaatgtaaactgcttcaagcaatataacaccataaataaaaatggctaattttgaaagcatgagagtgtacacaagtctgataatttcaattctccatcaactcaaagaggcatcatgggagcattttatataatcttcactctccttgtcacaaattcaccctgagggaaactaatcttgatggagaagtctgactgtcttgggtagggaaaaatgcatatgtgagtattctcatgatgaaatttaaactatgattttggtgaaatatttgaaatgtaactaaaaatatagctttctccaaattgctacaatatagtttttaattatgttatctttctccttttttaaatctgtggatctattttcaagctattccaatagctaacattttcatttttaccccctactcataaggtaccactgtttgccgattatcatgtaagatttaattttattgatcattgcttataatgtgtgcctagagacagagaacaagcttccctatccaatttctattttcccttcaggttaataggtttccctttcccaatcattgagtattgcacataagaacaaggagaaaaatgtttgttgaggtatatttagaaaagaaaaagaaggaaaatcctcatttagtagtgatcttgtgtttttctctagttcattagaaaatcagccaatgtatgaagactaagctttaattaatgaagttgtcctatattataagagggttccaggatgtatcttacatgcaaatgttttcatctttttaaggtaattctattaatatacctgctgtgccctaagggtcctagtctgagtacatttatccctttagcaagatttgggggtggaggccatttgtattctcttctattcatgttggactttagttggtgattagacacagtagacaatgtcatgtagggttagatattcatgtatggcttagatgcaggtagattttacctccacaatcatatgaacattgagtgtgtctcattggatttctgtaagaatgacatgaagtgaagaatttaaacttcttgacaaattacatgacacagaaaccactccataagtgttagataatcttttgtacgtgaatgggaaataataatatatattcatattttcatgttttggcctaaaggaaatctagatattaaatactagatcctggtgggaagattatttttttttcagggtggaaactgagcagatggaggacaaggatggggaagatttttctatacttttgttatgtttttggactttaatccgtatgactgtattatatatttgaaaaggcaaatataaaagtcatctgagctttttgtcatcataatggtatcctttctgacaatcgttgcttttaatcctaaaatgtctcatcaagtgcctttgtctcacaatttatctgtagaacatatatgcttgtgtgtggaatgagggctactcagactgtgaactcagaacaggcaaaatgtaaatgctcatttaattgctgttttgtagatctaaccaatttctatgactgtgtgaaagtggttaatgaggtttttctttctctttatcagatgatagtccaccttctaagataaaccttctctgtgttgaagtcaggcttagataaggaataagttattaataatcatgaaatctaataattaatagctttattagaagactagggagaactgatttactactaatagtaattattcttaattacagctaacctttgttggagtgtacagtgcaaagcactttaaatgtattatttgatttccctagcaaccctatgtggtacatggtagacggtagatgctagattaataaaatgacaaataaccacttggaaaatttgtctaaaatcatgtggctggtaaatggtctcagagccaagcctttttaatgccaaaactttttaatccctatgctctagaccatcacactgctgtatgtaagcagctttcaattatgtagtttaagaaatttttatttagcaactatttctggagtaattagtgattgttccattttgtagggaactggggttgccaagtcgacagatattgggctcataattcatatcatgcattgacagcatgtatgcaattaaccatctcaagtggtagcactgtcacgacaaactgcctgttcagtctcatgcatttctgtagtattgtaatccaaagatagtggggtctcatagaataaaatcaaatatattatccatgatctgaactatcagatattatccatatctgaacaatccatgaaaacatttattgttttcctcaatatcactcaaaatagattttagccctcttataaagagtttaaacagcaatgataacagtaacaaaaatggctttttattttctggctaaattatactttacctatattcatggttgtttacaattaaaaatgatcattctcaatagaatgcatacacatggtcaaaagctgtatccacatattaccaaaagaaactggtgattttattttttaaaaaagtaacattcaaagtcgttttgttacaggaagaaaaaaatgtctatgaaagctggatattttacttttcatttatttttgttgtatcatgtgaagagagctggagattctctgtttcataattttaatatatggattaaattggattattcagaaaaattctacttatgacacttctctgtactgttttattacttgcagctacgtaactctaatcctaatagaacccctgttattcatgacgctatgtaagctttgttgcattattcatgtttactttatttaaatttgtgtctgtgaactgtttgatttgtgaggctctcaggaaactgtcatcaacagaaatgacaagaccaagcttgtaaattacattttttatatgtgctaaagtctagacttctatgttttgctaaagaaatcaccctattaaaaataataacatgtatccttaaagcagagtgtctatgatttataggagcaataggcttgctcggaagtggggtgcctgcagtatctttaccctgtttacttgttccaggtgcctattgacttctcacattgttgccactataacgcggatacaagctgaaactcacaattgttatgttttgaaacttgctaaggtaatgtttttctcttgccctaaatatttgaagatatatttgaatagatcagtgtcttttcacccatttttaaagcacacattgtcttgtgcttctctttttaataggatggagatgagtgagacttgttttcccatttttgacatgcttgagcaagaaaacaaagctttccaccatcccccaaatggaaaaactgcactatgctagatgggttttgaaaaataaaaacacaaatcaaaaccttctaacagcacatctgttcttctttacaggaattagacgatataagctgcagctcagaatcagaggtaagcattacatttaatctgtcatgcctgcaggtttttatgaagttcaaacattttaaaaggttcagcttgataaaactccctcattatgtttcttgaggttagtcctgtcatctttgtccagtgtctcactaacaacatttccagttcagtaagagcagacattgctcattgcattttatttgatctcaggctatttaatactataagatgttgtgtgcacaccattcctttgggattttaaaccattaggttaaaggtacatccaattatgtgatatctttaagcaacttgaaggtgcagttttatatatagaaatttaccactgaacgatactgaaatgaagttaaggttgtgaaacacactgacaaaagatagggaatccaaagttaggaatgacattttgtccttcccttgtgctatactgaaaatgaaggaagttgagttgagtacaagataaactcaaggacactgaggattttactttttaaaatgtccttatagatgcatcatacacaaggtaacaataatagctgtacttatggaatagccgggagtttaaaacaccctttcactgatacgattgtactggaaccttaaaacagtcctattcacataagaaatcggtgattttagtctgttttccccaatgagaacacagagaatctacaagtaattataattttttttttacaattgcaaaagcagtaagaaatgtagcagcatgtcagagcctgttcttcagacatcaaggttggtactgtctgtactacacagtctcactgctgcctataagtatatatgcgtgcacctatcaacacacttatgtacaaacacacataccagtggatagtgagaggaagaacaaaagaaccagagaccaagtaatatgtatttgctggataaattaagctgttctctctttcatgcaattcaattcaaactgctttaaacattaaaagaaatgtattggctgatgaaaacataaaagtccagagtcactgttcttgtgagtttcctagatttgtcctcaagtgtgccagatttactgtgggcatgccttgtgcttgcaaaaggtcaatggcagtttcgggaaatctgtgacccagagttcacagcataaatcctgagtttccaataggttgaaatagccatgaaaccatcctgtagccaagcgtaaagcacatagacttggattagcttcagtggtcatcatggtaagggggaatggaatatcctgtttgcattgaacagatatacttccccattatagagaaattgtctatctcatatgactacaaggatgttctgcaatggggaatagtatattaattctatgcacacaacctcaatatgtactataactctgttttagtatgtaactactctgtgctaggtatgtagaattctcattatttgactttaggtataaagggatacataagtgtactcctaaatatgtgtaagatcatacttatgttctgataaataaatccatcaattcatttttatttcattcagtttaatttttatttgtacacattttcatgtatggggtacctgtgaatttttatttgtacacattgtcgtgtggggttcatgtgaattttcttacatgtgtatagtgtgtagtaaacaagtcagaatatttagggcgtccatcgtctgaatacattttgttaactataatctaccctgctatcaaacattgaatcaatcccatctaactgcatgtttataccctttaactcatttctctttatactcccccttcccccaactcactcctcccaatctctattatctttctttccactctctacctccatgtgatcaaatattttcactccagcatataagtgagaacatacaatatttgcctttttgtgcctggcttagttcactaaagataatgacctccagttccatcaatgttatgtcaaatggcatgttttctttctttttatggacaaatagtattccattgtgtatataccacattttctttaaacattcattcactgatggacacttatctttgttatctacctttgttattataaatagtgccataataaacatgcaaatacaggtattcctgtggtatactgatttcctttgggtagatatcagtaataggattgctggatcaaatgatagttccatttttagtgttttgaggtatttccatcctgttttgtatagtggtttactagtttacatacctaccaactgtgtatgggtgctcccttttctctgcatccttgccaacattcattattttttgtctttataataatggccactttgattggggtaagatgatacctccttgtggttttgatttgaatttatctgattagtgacactgagaatttttcatataactcttggccatgggcatgtcttcttttgagaaatatgtattcatgtcctttgcacactttttttcttttttcttttttgagacagaatttctttcttgttgcccaggctggagtgcaatggcgcgatcttggctcactgcatcctctgcctcccaggttcaagcgtttctcctgtctcagtctcctgagtagctgagattacaggcacatgccgccacacccagctaatttttgtatttttagtagagatgggtttcatctttttttttctgtcgagttgcttgatttccctgtatattctggatattggtctgctgtcatgtgtttagtttgcaaagattttctcccattcaataggtttcttcacactgttcattatttcttttgttgtgcagaagctctttagtttaagtctcatttgtccatttttgtttttgttgtctctgctttggaaatcttagtcataaattctttgcctagaccaatgcccaagagagatttccctaggttttcttccagtatttttatagttttgggtcttacatttaagtttttaatccatttttgttgatttttgtatatggttagagatagggatctagtttctttcttctgcatgtggctatccagttctcccagcaccatttattcaagaaggtgtccttcccccaatataaattcttgtcagctttgttcaagatcagttggctgtaaatatgtgactgtgtttctgggttctctattttgttccagtgggatatatgtctatttttaaaccaataccatgtgttttggttagtatagctttgtaatatattttaaagtcaggtaatgtgatgccttcagcattgttccttttgttcaggattacttggttatgcaggcttttatttcactctatatgaattttagaactttgtacaaaaattctgtgaagaatgatggtattttgatagggattgcataatctgtggtttttttgggaaatatggtcattttcgtgatattcttctgatctttgaggatgggattttttcatttttgttctcttctatttatttaatcaatgttttgtaattttccttgtagagatcttaaatttagtcctaggggctttaatttttatagctattataaaagtcattggcttcctgatttctttttcagatagatgactattggtatatagaaatgctactttttttttttttttttttttttttttgagaagaactctcgctctgtcacctaggctggagtgcagtggcgcgatctcggctcactgcaagctccacctcctgggttcccgccattctcctgcctcagcctcccgagtagctgggactacaggtgcccgccaccacgcccggctaattttttgtatttttagtagagacagggtttcaccatgtttgcaaggatggtctagatctcctgacctcaggatccacccgcctcggcctcccaaagtgctgggattacaggtgtgagccaccacgtccggccgaaatgctactgatttctgtatattgattttgtattctgcaaacttactgaatccatttatcaaatctaagagctttttggtagagttgttaggttgttctcaataaaagatcatattattagcaaagaggaacaatttgaattcttcttttccaatttggattccttttacttatttttcttgcctgattggctaggacttctaatactacgttgaataggcatggtgaaagtgggcacccttatcttgttccatttgttagaggaaaggctttcaacgtttcccattcagtttgatgttagctgtgggtttgtcatatatggcctttattattgtgaggtgtttttttctatgtttagtttttgagagtttttatcctgaaggattgttgaattttatcaaatgcttgctctttgtctattgagattatcatatttttttcttcattctgttgatgtgatgtattacatttattgatttgcatatgttgaaccatccttgcatccctgggataaatctcactcaattgtgttatcttatctttttaatatgttgttggattttgtttgcttatattttgttgaggaatttttgtgcatgttcatcagtaatattagtctatagttttcttttgttgttgctgtgtctttgtctggttttaatatcagggtgatgctgctctcatagaatgagttagagggattccctcctcttcaagggggaattttttggaatagtttcaggaagattggtattaattctttgtaaatttggtggaatttggcagtgaaaccatctggtgctgggattttctttgttagaagattgtttattcctaattcaaccctgctacttgttattggtctgttcaggttttctgtttcttctcgattctatcttggtaggttgtgtatttccaatactttatctatttcctctcggttttccagtttgccaaagtatagttgttcataatagtctctgatgatctctttatttctgtagcatcagctgtaatgtctcctttatcatttctgattttgtttatttgagccctctctcagctttattagtttagctagcagtttatctattttgtctatcttttcaaagaatccacttatcattttgttgattcttttaaaaatatttatttcttataaataagttttattttctattcagtgggtacatgtacaggtttgttacataggtatattgcatgatgctgaagtttggggtacgattgatcccataactcaggtagtgagcatactactcaacaatgtgtttttcagccttctctctcccccttcatccctccctctagtagtctccagtatctatttttgtcatctttgtgccctgagtatccagtgtttagctcccacttatagtgagagcatgcagcatttggttttctgtttccatgttaactcacttaggataatggcctccagctgcatctgtgatactgcaaatgacatgattttattctttgtgatggctgtgtagtgtttcatggtgtatatgcataccatttcatttatccagttcaccattgatgggcacctaagttgagtccatgtctttgctattgtgattagtgttgcaataaacatgtgaatgcatgtgtcttattagtaaaatgattcattttcttttggaaatatacccagtaatagaatgggtggccaaatggtaattctgttttaagttctttgataaatctccaaactgctttccataatagctgacctaattgacattcccaccaaaaatgtctaagcattcccttttttctgcagccttgccagcacctgttgttttctgacctttaaataatagccattctgactggtgtgagatgttatcttattgtggttttaatttgcatttttcttatgattagtgttactgaacatattttcatatgtttgtttgcttcttatatgtcttcttttgaggagtgtgttttcatgtctttagtgctatgtgcctacttcaaaatgttagatctcaaaataacatatctgaatgtctaaatttcttgccaaacttgggctattttcatctattattttgttaaattgattttataattcttttattttctcttcattctgagaggtaccaataattcaaatatttggtcactttatgtcataccaaatcacaaaggatttcctcattcttttttattctttctgccttatttttttgtctagctggattatttcagaagaactgtcttcaagttctgaaattctttctgctcttaatctagtctactgttgaagtttttgattttttatatatattttttattttttttattttttatttattaatttttttttttgagatggagtctcactctgacacccaggctggagttcagtggcccaatctcagctcactgcaacctccatctcccgggttctagcaattctcctgcctcagcctcctgagtagctgggattacaagcacgcgccaccacacccagctaattttcgtatttttagtagggatggggtttcgccatattgcccaggctggtctcgaactcctgacctcaagtgatccatctgcctcggcctcccaaagtgctgggattacaggtgtgagcccctgcacccaacctatattttgtatttctttcaatgaattcttcaattccatatttttatttggttcttttcaaaaatatctatctctttagtgaatttctcattaatattatgaacggattttctgatttcttcacataatttttcagatttttttttctcactgagcttatttaaaatcagcattgtgattttttaatttggagtttgaaaaatttatttttgattaaagtgtattgctaaagaattattgtttatttagaattgtcatatttccttgctttttcatgtttcctatttgcttatgttgatatctgcacatcagatgtatcagtcacctttttctatttttgaatttactttgtagaggagtactttttttctgtattcatggtacggtgagtaggacaccttggctttgattctggctatgtgcaatactgtagtctctgtatgatttctttggcagtaaacagtgttacttctacctgtgatttcctcttaagttgtgattattagtggaggctgtggtgaagttgtgctagggactgggatgttaggtaggtcagtcttcaggcctcagtggtaacaaaggtgggttgagcatgccccaatgccattagcattgtaccccaaggcagtttacactagcccccatgttggcgattactggagagccaaatttcgagcctatgtgtggcttgcttgaatgctggtagtggcaggcagtggtggatcaggtaggtgggtgggttctcaggccactgggcagccagtgtgccatgggcagtggctcattcacagctcacaatctattctaagtagtgacactgtgagtttccctaacacctcactccaagcactgctaagccccaggacactgtgcagtcatccaagtgctaggtaagaaaatggtgccttgctctagccacttagatgtcagaaagggtgtaggacccagcatgagcgccctccctgggttagcttcattctacgatcccctgacagcttcttgtgttagtttcagggcttagagggctagagggactttcccatggctaagattggatgattccactgtgggaatataagctgctagaagcctctcacttacccattctagcatggagaactcactcctggctcccacccaattcctgcccctagacaaccccagccaagcaggctgcctttcttctttctctttccttgcttttcatattttctctcacttttttaagagaaaagagagagttttctctcttgaataatgtgttttaattgtgcttatccgtatactatttcagttcttctaagtagaagtgagcctaaaatgcttctagtcagccatcttgaagcctttcctcaaggcagtttttaaaaattcagtttatttctacttttcagtttccattatccttactctaacaaagccaaattttaatgcattggatagatatcttttattgatgtgtgtttcatagatttgttttattgttttgtgtgcaaaatagtggttgcctaagtcgtattgtgttatctaaagaaacaaatatgttttcttggtattcctatattggcacggaaacatctagtttatttcttcctattgttgtgtggttctacagggtgagaatatactgcaatttacttaatcactttcttattaatggataacaatttggcttccagcttcccacccaccacaaatatcattgcaatatatttctgccaacatcttcttaaaaagttgtatgagtatatatttggcttatacacctgaaaccagaatgagaatgagtttgaatgtgttatttacatacttgtttagatactgatgaatggctctccaaaatgtctctacactcccctctagaaatacatgaggcttgtttatcttcatcatctaccaaactcagcattattcagtggcttccaaaaactctaaatgctgaaaatacttaccaatttgtatgttttataaaggggtttaatacaagtaagtacttggtttaaaaaaatcagtggatgggatgcaaaagcaagtctagactgggcctctaagaattatgtcagaaaaaaataatcaaatatcttctaaagagagtttcaaccttgagaccaccatggaacttttgagcttaacaacatatgatgcagctgctaagttaaggaaactacaactagaaaggagctctcactatcactacagatacaaatacgtcttggtatctcctaagtgacactcagaatgctggagaatcaatcatcactgcaggagtagctcagatctctggactgatttctgctagcagaaaatagcaaaaaaggcaagaagaaggtctttgtcattttctatttaccaattttatgagcattcacctaacatacaatttgtttctagaatcttagctgcaaaggagtatggggaaaataggggttttctggcctctataatgcaaaaaagcacattaaaaccatgtatgaaaaggattttgaaagagccaattcatagcatccaccatgccaactttctaatggttggcagtctaatgtgtgaaaatgactttgtgccttctgtctattctttttagaactgggatttccatttctataaaatacatattttttaaactttctggttgtaatcttgattatttttgttggtttgattacagattctagataatagacaccttgccattttgtacaatagaaatattcctcataacattttatgcctgttgacataattttttaatttacagaaatacttatttagtgtgataaaatgtgttattgttccacagatatcctgtaatttgagttttgtttaacaaggcctttcttattcctaggccgtaaggatgaattgtcttttaataaatttataaatgtaataatgttttaaaaaattaatgcccttaatttatctaaaaaccattgtgtgtattttgataggtagagatatccttatccttgttttccccttttaagtaagctggtttttcagcaccatttacctaacaattattcattctccgttaaattgttttacacctttattgaatctcacgttcctgaatgtgtgcatgtgtgtgtatacatgagtgcacatgtgtttggggtgtttattttgatcctttaatgtatcttttgcattacatcaatgtcatccttttttttattattatactttaagttttagggtacatgtgcacaatgtgcaggttagttacatgtgtatacatgtgccatgatggtgtgctgcacccattaactcgtcatttagcattaggtatatctcctaaagctatccctcccccctccccccaccccacaacagtccccagagtgtggtgttccccttcctgtgtccttgtgttctcattgttcagttcccacctatgagtgagaatatgcggtgtttggttttttgttcttaaaatagtttactgagaatgatgatttccaatttcatccatgtccctacaaaggacatgaactcttcattttttatggctgcatagtattccatggtgtatatgtgccacattttcttaatccagtctatcgttgttggacatttgggttggttccaagtctttgctattgtgaataacgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttctgttgccattgcttttggtgttttagacatgaagtccttgcccatgcctatgtcctgaattaccatgcctagtttttcttctagggtttttatggttttaggtctaacgtttaagtctttaatccaacttgaattaatttttgtataaggtgtaaggaagggatccagtttcagctttctacatgtggctagccagttttcccagcaccatttattaaatagggaatcctttccccattgcttgtttttctcaggtttgtcaaagatcagatagttgtagatatgcggcattatttctgagtgctctgttctgtttcattggcctatatctctgttttggtaccagtaccatgctgttttggttactgtagccttgtagtatagtttgaagtcaggtagcatgatgcctccagctttgttcttttggcttaggattgacttggctatgtgggctctttttggttccatatgaactttaaagtagttttttccaattctgtgaagaaagtcattggtagcttgatggggatggcattgaatctataaattaccttgggcaatatggccattgtcacgatattgattcttcctacccatgagcatggaatgttcttccatttgtttgtatcctcttttatttcattgagcagtggtttgtagttctccttgaagaggtccttcacatcccttgtaagttggattcctaggtactttattctctttgaagcaattgtgaatgggagttcactcatgattaatgataaaggggatatcaccaccaatcccacagaaatacgaactaccatcagagaatactacaaacacctctatgcaaatgaactagaacatctagaagaaatggataaattccttgacacatacaccatcccaagactaaatcaggaagaagttgaatctctgaatagaccgataacaggctctgaaattgtggcaataatcaatagcttaccaaccaaaaagagtccaggaccagatggattcacagccaaattctaccaaaggtacaaagaggagctggtaccattccttctgaaacattccaatcaatagaaaaagagggaatactccctaactcattttatgaggccagcatcatcctgataccaaagccgggcagagacacaaccaaaaaagagaattttagaccaatatccttatgaacattgatgcaaaaatcctcaatgaaatactggcaaagcgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcagtaaattaggtattgatgggacctatctcaaaataataagagctatctatgacaaacccacagccaatatcatactgaatgggcaaaaactggaagcattccgtttgaaaactggcacaagacagggatgccctctctcaccactcctattcaacatagtgttggaagttctggccagggcaattaggcaggagatggaaataaagggtattcaattaggaaaagaggaagccaaattgtccctgtttgcagatgacatgattgtatatctagaaaaccccattgtctcagcccaaaatctccttaagctgataagcaagttcaggaaagtctcaggatacaaaatcagtgtacaaaaatcacaagcattcttgtacaccaataacagacaaacagagagtcatccttttttttattcctttgggttcacagaatactctaggctatatctcctccttttgtatttctttttcaaatttgagaacaatcattgatctgtattttccatataatttttcagttatttttattgatatcttcataacactaatcagagattttggctgagattgcattacatttataggggattatgtaaataattggcatatttacatgtcatttcattaaatatctctatattaaacaacaaagtctctgtcctccattagttaaaaatattatccgtgatattcttaactattagattggttgattcctaaatagtaggttgaaccatatgaatatatcatttttattatttataaaagggttggttattgttaaattcacatggttaaacttagtactttgtagttttattgttataatcaattatatatttcacttttatatttatttttggtgctgagaacaactattaatttgtataaattaatgatggtttatgcagccatgtctaatactttgttggttgtattgctatctttttctgaaataggtattatatcatctgccaataataacagtattatcactttccttccaatacttaacacctcattcctctttcttttcctacagaattgatcaggttatagggtatttagcatgcatgccaataaagaatattgttatagccagcattcttttttctcattagtaaaggaaatgatcacaattgttttctacttaccatacatttctgttatataagcttcactacattcagaaatttttttttagattttataggttgctgacagattattatgtttttgtcccaaatgtttaaagaaagatttatttgaatattgaatattgaaattattttttacaggaatctattactataatgaattatactaatggattctctaatgtttatcatctgtggatacaagtcatccaggtacagcttatatttcaagcaagccttccttgcagctaattagagttatatgactaaatatgggaaatagaatgatagtaaagttattgtgagtgacttacaggttatctccaactcaacacacaacagtggccctggacattgaccatttctcccttcttgactagacatgacaataactggagtgactttagaagccataaattaagtgttgacatgtcataccatcctgaaccaatcagaatctcccatgagataaaaataaacttctatctatgtaagtccctgaaattttgttgttgttgttacctcagttaaacctttatcctatctaatgatgtctttgaagtttggtgataaaccctaattcatcagaatgcattataacttttctaaatgtactattagattagtttgaataatgctttgttgtagattttagcatttctattaataagcaaaatgtggctaaaattttactttcttatataattagtatagtcaatattttacataatcttatatagaacataattttaaaataaaaattatattagacttttaaattaatcttgacagctttttctctttatttaatttccaaaaaagaaatgtgtaaaatgcatgttctctaggctgaattatatctgccaaaaaaatgtttaattcttaaccaccgggttctataaatgtgacctattttgaaaataaggtctttgcagatgtaatcaagttaatataacgtccctagggtatgtccacatccaatgtgactagtgtccttttaagaggatgagaatggactcaaaaacacaccgatgaaaatgctgcatgaagacagatatacaaaggaagacagccatgtgataaccaagaagagattaaatttatgcagctacaagccaaggaatatcgaaggttgcaacaaccatcagaagccaagaaagatcattgccttgctgacatcttgattttggacttctagcctccagaactatgagagaatacatttctgttgttttaagccattcagtatgtggtagttaattatgtgagccctgggaaactaatacagattttggcactgggaggtaggatactgctgtaacaaatatctaaaaatgtgcaagtggctttggaattgtgtagtaaatagagtctggaagtgtttttgaagcatattctagaaaagtttagattgtcttgaagaggctgttggtagaaatctggacattaaaggtgttctggtggggtctcagatggaaatgaagatcatgttttggacaccggagaaaaggcaaccctatttataaaataattgagagtttgatgatttggaaaattctcagctattcatatttcaaagaatgggaaagcatgttctggagagaaaacaccataggtgtgtctgaataaatttttgctacagagattaagcgtgtgactcatggatccaatcaactatctcagtagaaacggtcaccttggatgaaagatgatagaaatgaacaaagggcaggaaggctgttggactttttggttccacaaacagaaaatgggcagctagagctgcttggctagcaacctctgttagccttcaagaaaaaaataagaaaatttttaagggtggctcagatgccagtgggattttcaatgtctgggagggtgggatggttaccactgtggatcaagagggcagggccactgctattgaataccagaaggggatagggagccatctcagtgggttcaatggaaagagtcacggagaattattctcagaacttagactttaatggaattttctctgataggttacagacttgcttgggatatgtgaccctttcttttttttcttttttgaatttctcccttttggaatgggaatatctattctatgcctattccaccagtgcattttgtaaaaaaggtaatttgttttctctatttcagaggtccacagataaagaggaattttgccccaaaatgaacattacccagcatctcatccatatctgattctgaagttttagaagatgagatttgggagttgttgagttacttttatttagaagacattttggtgttagaggtcacattaggatgggttaagattttgggggatgttgggatggggtgaatgtattttgtatgtgaaaagatgtgggttggggatctagcaggcatattaatatgggttgaattgtgtgcccccccacagggatacgttgatatcctaacctcaagtacctatgaatatgaccttatttggaaataaagacattacagatatagttaatatgaggtcatcagggtggacctaatctaccctgattgatgttattttaagaggcgaacagacaaatgcatatcgaggagaatgctgtgtgaggacatgaacgcacgaaaggaagatgaccatgtcacaacaggaagagtttggaattcagaagatgcaatacaagaaatatccagcaaccaccagaaggagaggcagcgtggtcttgccaagatctttcttttagacttctagctctagatctttgaaagactaaatttctcttgttttgagccacccagtaggtggtcatttattatggtatccctagtaaaaaaaaaatattctggatagtttggtaattctcatttataaaactatttatcggtgaaaccccatctctactaaaaacacaaaaaattagctgggcgtgatggcgggcgcctgtagtcccagctacttgggaggctggggcaggagaatggcatgaacccaggaggcggagcttgcagtgagctgagatagccccactgcactccagcctgggcgacagagtgagactccgcctcaaaaaaaaaaaaaaaaaaactattaatacaatgataattattactattaatttctattggtgggaggctgcttctgagatggaaaacatgtctttagctacaatttaaatttacttaattctaattagtctgttaaaatattctatttattacatatttgtaatgaatttgtcatgtcatctattttctttatatatttattagcatagtattagcatgataatggccttttttttgttcaacagtccttcctttagtttatccctctttctcctctcacaattccttagaggcagcaaggaaaaactgaggggacccttttaatactttggctacaaaattttttagctggattacccaggcctttaagcacatttttctattaatacctgtcttttatcacagcatcctacatttgagtgccacaatctgaatttggtcatctattgctgcataaataattaatcccaagcttaggctcaaacagcaaacacttattatgtcacgaaattgctagggccagacaccttactttcttgccatatggccttctccataggctgcctgagtaccctcacatagtggcagctagcttcactcaggaagagcaatccaagaagagtgagagcccagcctaatcttcaaagagttatgccatcaactcttctgtattctatggtgacgcagacctattctggtacaatgtgagagactttacaagggtctgaacacaaggaggtgggggtaatcgggagcaacttggaggttagcttccacagttattaaggcataatctccaccatacaacatgaggagtgggctttgccaagagtatcaacatacattctgctggatcttcatctaatggtcagttgaaatggacatattggaatttattataaaataataattttaaatgatttttaaatgatttgctacacagatcagttacctgtaatgaaaaactaacagacaagtgatttttaaaaattggatcagtatgaggttcacctataatatgttcacactatcctggcccctgagagtaatattataataaaactcatttttataagtgacatcatcctagtcttggtatcaaatgaggcataaatggattgaagtgctcatttggcctaataatgtagcgaggttatttcaattagaatcacccagctactagtaatctgactatgttattggagcaattcctttaaactactgaccaagtcttgcctggctcagcaggccacatctaatgtgattacctcctaacgtgttatgacatttaggaattctatacaacaatcttaacaggacatagaaataccacttctataaaatgaactgacatgaagttaattctttaacgcatttcattaagagaaaagtgtttactttcatctctgcaaacaattccctcattaatctgggaaatatcacctgagaatgctattgaagtcgataaaatcaaataaaataatgacaggtaccgacaggaatgcaacaaattctactccaaaatatactcccctattagagctgttgtaaaccatgcttggattcggctaccttggcagaagatttaaaaagaaaagacacattcacagctgtgtaattagaggagaataagaccagcaattagttgtagagtaggtgttacttctatgttagcatctattttcagttttttatgttttgctttatttcctgtttcttgctgtctataagaatttccagacaaactttgagagtctgggccatgtttaacaaaatcacagaatactgagattaggaggaagtttaacctaatgttgccaattcctgtttagacttgtttcccttcgaagcaactaatttttacctctggaatttgattttgaccctaaacttaatggaactttagtgatagaactcattgccttctgaaggagtaccttctacaaaaagttcatttgttcaattgcaaagttctttgtcatatcaagcttgtttatccacttgaagttttcatatgttgacataaactctacctttggcaatatctagcacaagtctcatttctcttcagcaaaaaagacccttaaaaatatttatgataaacccttttgtatttttgttgctaaaagtggaatcacctcataaagctgaatgatagcattactgagtctcctgagatgggcttgtcatcacatttttctttctgtgtgcctttacgacatcaagaaggtgcatgattgctgtgtatttccagctcatgagagatttggtcttgctactcattgacatggaaggttagcctcagtcaaaagagttcaatagtcttccccaggagtatacttcttgactcacagtgacacaacaggataggtgaatgaaataatcttgagagtctgtatgctagtataaaactagtgagggcagacattaaagactcataaaattaaaaatcaagagaaaggtcaaatcagatgtgaaaagtattgtttcttaaggaacttacacatccaggatgatgtcaaagcgagagacagagaataaagaggggggacctttaagtcaggaatatagcatggtatgtgatttgaagcatttactgaatgccaacgctatgagtgttcgagtagtactctggaatgttgagggaggggatcatttttaatactggaatgagaacctgggaagtagggtaccaaaacatgttgaattgattcaagattcaattaacagggatttattgatgttctatattgaggcaggcaatgtttcgggtacagaatccacagttttaggcagtgagacactcacaaacttacaatgctattaaagttgtgtggcaatacactgaacataaataagacatgatatgctgattttgaagttgtgaaagagtttgtatctggattattgattttatagtatattttgccaatagaagttataaaagtattatggtatgatttttattgtgtacattttttgtggcttaataccaatgagaagttgtatttgccagatgttatatggtttaaatacgactaaaaatcttaagttatagtttacttgctctggttggttctctttcagtttgtttgctctccctgaaattttagatatcagtgtaaggaaaaatgagtgagactgccatagaaattcagagctttttacatagtccaactcagtatagtcagggtaatggtgtcaatgagctttgtaaacaaaaattgctgtgggaaaatttctcagggactgtaatagtgagatgaagcccctaggttcatactgtggaaccaaaggcaagacactgagattaaagcattttgtaagcattaagtactaatcataagtagaaaatgatcataagtttttaaaagaaaaaaatagcatatacatagaaaaggattttttaatcaactgggcttttagatgttactagtaattgctaaataatattccagaatcgtctttataaaatcatatagtactagagttttagtttcagaaaggtgggatagacatattttccctatttcctcctgctaagtacagctaaaagccctgaatattatatataaaataaacataagaagattgaaatgtgaaaggaggaaggcaactggctaaaggccttaggacccaaacactaacataataggatgctctctgggttttctttttttactcagatcacaaacttaaagaagccagaaacccagaaataccaataggtgtagacaaacaaaacacaacaaaaaactctaaacaaaactctaatctctctagccaaaagatgaagaaaaaatatagtgagacagatagctgttagataatagctgctttactccagccaaacaccactaaaaagatcatagtcccatacccatcagcagaagccaagtggggagctagattttcctgcttacaagggtataataagatactccaataccctatcatgatggtgtcagagaaggcagagtaggaacataggtctctcactcctttcagacaataagctcccttcttccactgcaggatcaatagagacaacatatggagcctggacttccactccaatcatgcattaatgatattctcctccctgtttcaactgggtgctatcagagcagactcagtagaaagtcaggacttttaccaccaaacacacattttagaacaagaatctaagacatattttagaacttgaaaatattacaactgagacaaacaaaacctaaaactcaactctctgtgggcgagcttaagagcagaatgaagaggactaggggaaaaaaaaattagagaccttgaaggtctctgataggatcttcagagacaaaagaaattacacttctaaacaacagaaagactgcaaaaataaagcaaaaaataagaataacaaaacccaaatcctcaagaacatccgggagtataacaagggatctaacatttatgtcactggagtctcagaaaaagaggagaatgaagctataagaatattcaaagtaatgttggctaaaaagttggaaatttgaataaaaggctaaacccttcagatttaagaaactgggcaaacttcaaataggataaatccatagaaatctgcaccaagatgccttggagttaaacttctgaaaactatatcatgaaaaacaattttaaaggagataactaacactttccctacacagggaagataattttaatgacagaggttttctcatcagatccatagagactaaaaggaaatgacacaatagtttttaagtactgaaagaaaagaactgtcaacccagaattctacaaccagaaaaaaatctctcaagaaagatgaatcaagatagtctctgatcaaggaaagctaacagaatttctccccagtagatttatccaaaaagtcttaagaaagttctcaaaaagaaaaagaaatgttaaaaaaaatcttgggacattaggacagaagaacaacaaagaacaaaaacaatctgggtaaatacagaaaaattccccactcctcttgaattttgtaaatcatgtttgatgtttgaagataaaattttaacagtgtgtgctatagttctgcaaaataaaaacaaacaaaaaaagccactaccaaccaaaaccaaaacaaactaaccacaacgctgcagctgggtgtcagtaaaagtaacgttctgttgcaaccagatattaaatgtttgatctccatggtcgctttccatggatttggacaagaaaatgaaacattcttcaaaaaacattcatgttgtatacttaaaatgtaaatttttctacttaaaggtaccaacatctttggtatgggagaggacagaaaagcagaaatggagtattttattctctgaaggaggtaaattaaataagaacaaaccataaataagttgagaagtataaattaaatactaaatgatgtaattcatactcaagtgttagagaagaatagattaagacacaaacacgaaggatttgggctggactttgaaggatggaaaagacttagataaaattaaagacaatgcacagtgggagaaaggacacagaaataagcatgggcatggaagcaaccaggctgagatccttgatgtcggagtgttgtattagttttctacagctgccctaggaataaccacaaactgtataacttgaaaggacagaaatttattttctcatagttgtagagacaagatgtctgattctgaaattcgggtgttgactgacagaaccatgctcctcctgaagttctaggagatggtccttccttgtctctcccaagcttcttggcattccctggtttatggcagcataaactccagtctctgcttccatcttcacatgtctttttccctctgtgggtctctgtgtccaaatgtcctcttcttttttttttttttttttaacagatttattttatttttttttattttattattattatactttaagttttagggtacatgtgcacaacgtgcaggttttttacatatgtatacatgtgccatgttggtgtgctgcacccattaactcatcattaacattaggtatatctcctaatgctatccttccccccactcccccacaacagtccctggagtgtgatgttccccttcctgtgtccatgtgttctcattgttcagttcccacctatgagtgagaacatgcggtgtttggttttttgtccttgcgatagtttgctgagaatgatggtttccagtttcatccatgtccctaaaaaggacataaactcttcatttttatggctgcatagtattccatggtgtatatgtgccacattttcttaatccagtctatcgttgttggacatttgggttggttccaggtctttgatattgtgaatagtgccgcagtaaacatacgtgtgcatgtgtcttcacagcagcatgatttgtaatcctttgggtatatacccagtaaggggatggctgggtcaaatggtatttctagttctagatccctgaggaatcgccacactgacttccacaatggttgaactagtttacagtcccaccaacagtgtaaaagtgttcctatttctccacatcctctccagcacctattgtttcctgactttttaatgattgccattctaacaggtgtgagatgctatctcattgtggtttcgatttgcatttctctgatggccagtggtgatgagcattttttcatgtgttttttggctgcataaatgtcttcttttgagaagtgtctgttcatatccttcgtccactttttgatggagttgtttgtttttttcttgtcaattattttgagttcattgtagattctggatattagccctttgtcagatgagtaggttgcgaaaattttctcccattttgtaggttgcctgttcactctgatggtagtttcttttgctgtgcagaagctctttagtttaattagatcccatataaagagaacattagtcattggattaggggccgctctaatccagtgtgacatcatcttaatggctgtatttacagagatgctgtttccaaattagtcacagtcacaggtaccgagtgttagattttcaacatatttttcaagcactagtcatatttctcaacttgaagatgtgaaaagtagtactttaggtgggtttgaattttgtggagccttagaaactatataatatttgcatttgataaagagccatgaaactgattcaaaaccaacccaatactgtataaactctttctcactttaaatatagacacatacaaatagaggagcatttctggtagatttatagatagtaaatttgtaatagtaaatttgtaatcaaacattgataatgaaatatcacatcaaactaggaaccaggagtcttcatttctaattctgtcaccatctctactatgccccatgaccttaagatacaccttagcatgaatatgggattatttttaccatctatgatatagataaatttctcagcttcataataataaacatttttattgcatgctatatgtcaagcactaatacatatgctgaactatttacctgaattgtctcatttaatagttaaaatattcctatgagttaaatcatattatccttactttttaggtgataactaaagcccaaacagagttttgaaaactgcctcagtcaaagggtggtattaagattccaacctatatttatcttagtcaacagctaggttcatagccagtattcaatcaagggttcacaaattgtgagcccattgatgatatatggcccaaagatatatgttcttagatatacattctgttttaaaagaatgagccaacatctaaaacatcaaatgattttacattaaaataatttttataatattttgaaaaacttagtaggtcttgaacttctctgcccaaacttagctggaccttaagaacatttgcccatgcatttgcccatttagatattcatgcattctccacttaaatgtaatccccagctctccctatcacctccaaacacacagtgtgtcaattatgatttgtcattgagcttgcactattgttttcttcttacatctatagtggaacttctttttacccatatttcaaataaaagaagtggaatacttctttttacccatatttcaaataaaagtgagaaaattaacaataggctgaaatatgttatttttctcatgcctctcctagattcttcttttatgtgaacttgctggctcctataggcatgtaagtttgtaactcctgccatattgcctctggatcagtgatctcaaccttggctgtacacatgaatcacatagagagatttaaaaattcccaatgttcagtctgcactctagacctattaaatcagaatttctgtgcatggagcccaggtatcaatatttacagcatcccactgtgcagtcaatgttgagaaccactgctctagatattctttaagatatcttctgttttctaaattctaaatttacaattcaaaagccagttctaaagattggaatggttcgatatgttgtgtgtaagctgtatattggggatgtgggattgatgtagggacactgactgtggatctttgcttgccgagctaagcaaattagaccaaccctttagatgtgcagcccattctagcacacaacattgacatccagaggaaaagtgtcataagttagtcttagttatggggccaacagtttacgtgacctaagaaagtcatttactcagtctcggttttattttcttttttcaactatgactcaacagcgctcatatacaatgctgtatgcaggtcctatatttgcagtaaagacagtatcagaaaatcaaaataaagtacattcaagatatatacttactataagaacataaaataaattttttcaaacctactgatttccaacagaaattcagaaacatagggggacaactgtactgcagaaagacatgtattcagaaaggtaatcagaatgtgaaatgtttactgcaatgcttaggtaaggaacttttgcccctggctaccctccaaggtctagatgacacatgtctctggtgaatcatgaggttgctaattgtaagctttatggattcaacaaccagcactgagaagacctgcaatgatcagcagccaaagccaatggcacagcttggagcccggcgctttctgttctttgtgttcatactagttcattctctagagaaggtcagagtattccatacaaaactatgctcagttttcaagtgtgaagcttccatgacaggaaacacatcaaggcttttgacagctgataactttgtacctcctctctgaggggctcctgttcagaacaaaaatgtaatatagctccgggtgttatcagagctgttataaaatgcacttgggcattctgaggattcatgcttaatgcctttctataatttgtgcagaatgtgtgcagagtccttacagcatgctaataacattttgttatgacacagtgcagcaccacagagccaacttacataaggatagaacaatgatgtagaaggcaaagataaagattagaatttcaagttaaaaagcaaggttttatagaggccattgataggttggaggtaaagcaactgacaacaacttaaaatagttaaagacatttaggcatatcttagaatgagactcgactgacattttgaaggcaagcttataggaaaattaatcacatgaggagtgttcattgactttctatagaaaaagtattgagataaatttgcaggtattcaataaagtagagtgcctatcaaaataggcagcctgcgttaggacgtcaccattttccatacatgtgtgtgtttttcttcctaaaaatattgtctatatatgccagaaacaattgtggctgaaataaatttcttgtatcaacaggatctcagcttataactttacatctgagaatgaagccaaacagaagtacttgcttttgtttgtggcattgctcccgatttatttgaatttagtcctgtcactggagttcaataaagtcaggcagtgaatccatatggatttgggtaatagattgatgttctgataatgagaatcaatccagaattaaaattaattttaggtgaagagtaaatacactgcttttagatactcatgaaactctgcttccttcttgtaagtaatgatgagaatgacatggatatgtgaagaatagaatgcagaataaaaacagaataaatcttcatgtgtttcataaacaaaatccagggctggtggtaagtatatcaaagcatttgtgttttatctttgaaggaaatatgaaatgttacaagtttttcattaatttatgtagacactaagtaggacctgagagagaaataataattatacaaaatagtgttttattggataaatgcttttttgttaaactattgtacttgagtgagaaattatggtgtgtattttctttatattcactattgtgcattttgagatgccattatgccaacagattataggcaaacctgatgattatgctctgaactgcatccattatatttattaaaccaccttttctactaccttttatgaatgtttaactatagaaacttcaacgttttaaaaatgatttatataatcaaatcattcatgtataattaattctactaattttcatgagtgtttcaggtcattttggcataattagccattgttgagggttttctcccccatcaattaaactaattgctttccacataggtatagattgaatattgatccccatttttttcagctcacttgcataagcaaattatgcctaattgccagcttactacatcattacacacttatcatcaattatacaaaaatatactctgctagacaaatgatttctttgtggcattttgaagggctttttaattgtgatgcttagaacagtattgtcattttaaaaaatattaaacaccatgtttaaaccaataacgcaataaagcgtgttattggttaacaaacataccagctcctggctagaccatcatttaccttggaatataaagagtgtcttaaaacaatttgaaggaaactcattgttattaaatatagtaaatccaccaatgcaaatattagaataagttctttctaaattttttagcttaatctttatctttcccattccacatatttatttcttctctacctgacgaaaagtctttgagaagatctgaagaggtggtgaatttcaaagaatcactatacagaacacaccaacatttttaaaagtcaggagataaaagcaaccccattcatcatgcattctgtgcagagcattaatgtcttttagtgattttactgggcatttgtcttcactagtttctcagttagattctttaaaaagtacagaaagatatgaaaataatataatcccaagattctccttacagatttctacaccctatgacataattttcacacattagctctccatagagaatggagataaaccaaaagccaatattaaaatgtattttaaaataagtgggaggactgtcctgatatgacagtcttattttaatccttggctattccactaataaaatcatataatatgagccacttttacattggtgctcacctcatggaagccagacttttctcaacaggatgccacatttagcaaagtaggcctccacaggctgtatctaacacccacaaacaaaagctgaggatgcgaaaaggttctaaatgattctatcgcttgaaactgcctgataatgagtcttgaattacctgtggggatcttgatgatcaattctttatttacactttaggactaaccttactcttttcttattcaagaaagttggggaagacggaaagaagaagagtatagtaaatattcccttactcattgatatctttttaaaaccaaaatgggacaattttagaagaccatttcgttttaatcaatttaatgtaatttaaccattttctaaaattggatgatgattttgtgccacaaatcctaggctcagcttatggaatcacaggacatcagagttagaaaaccaatgggagatttacatagctttaatcactgacatccagtatctatttgaattcctctagtggcaggtgacttgtttttacctagaaagcagcacataatatttcaagggagcttcagtcatcacaaggttcttagacccattcatcccatctctgcactctttcaaatcttggaaagaacttatatttttctcctcacaggttatagtttgtgttgataactctcataaatgcctactcttttccattgttgaccaaacatccttagatctacattctccttgtatagtttcagacctttcaaaatctttgtctacggatatatttcatgcatatctcttttttgatggcatttaaggtctgtgaacaggaaggtagcatttatagaaatcatgaaaacaatacaaaattataaaacaaatgccaggcgcagtagctcacgcctgtaatcccagcactttgggaggccgagatggatggatcacctgaggtctggagtccacaaccagcctgaccaacatggagaaaccccgtctctactaataatacaaaattagccgggcatggtggtgcatgcctgtaatcccagctacttgggaggctgaggcaggagaattgcttgaacccgggaggcagaggttgtggtgagccgaaatcgcgccattgcactccagcctgggcaacaagagcaaaactccatctcaaaagaaaaacaaaaacagaaacaaaaaacagacaaaaatctattattttcccctttacatagcttttaaaagatacaaatacaaaaattcaccttacataaaatatacatgtattaagaatgctagtagagaataatacataaagttgtaaaatgtgtgctattttcatttcttaaaactggaattatactgagttgttattatatttgacaaaaataagatagaatatttaaaaatcttttacaaaagatggcatcaccaaactgttgattcatgataacttttaatatctgaaataaattttgttcagtctaaacactgctaacaagaaaatatcatgtaagtttaaataccatttgatattctttgggtctttcagtttattttatttttacaaagttttatgaatggatttatttaagtaatattataatgtaaataacaagtcaaaatcaggggtttgaaagaatcgtttctcttaaaatgggtctgaaccttattcgagtttgggaaacactgggctataaaataaaattaaactttggattggtatgccaggccttccatgatctggccctcatggtaccattgcttcatgtcctgtcagtctcttagtcaaacctgaggtcccaccaacactgtaatttccatgtccttattctagctgttccctctacccaggacaaccttataaacctactcagaaaaaataacacatcacagaccatagataggtcttgggattttaatcctcccagaatgacaattagaaattacctactcaactgaacaaaatggtacaatctgtctaccatctcatcatgagatatgtatgaagcagtcttccacattattgtgagggatagactgagcacctgtcaggccaccacaaggaagtcaatacgttccctctaagccagagaagccaggaccaatagcccagacaaaacggaaacttcaaaaaacaggcccccatcaggcttaaaatggtcactcccagtcattccccacaactgtcttaagcattttgcttgataaatacagacttttgaccagaagagataaacaactttgatgttaaggttgttatcatttgtgataacatttcgattgattttaaactttcaatggtacttcaatgatgtcaataatacaaacctgatttaaagctgggaatctaaaatgaagtcaagtatttgctgaaacatttctttattatgttcaaaatggtaactttcatatgaaaaaaagattgacaacctgtgtcacacctttactaagacttcacaaactcttttgtggccagtgttacttctgctttcataatggccgcttaaagacatcttgtattgtttatactgacaacacatctgtatttcttattgttgactcaaaatcctctctcattaacttgaattaaaatagaaaatagcactggtcaggcctaaaactactcagcaaacatgcactttaacagtaaatttacaactctttacaacagaaaccgcgcactcttctttaattgctacagagaggtcagtctttcaaaccaaataagagtaagagatgctgcttttatcatagccttatgcaattgtaaaatagagagcaaactaaggtctgccgttctttctccacctgcttacttttggttatatctcatgacagattttgaagccgatttcaaagggcaacatctgttgtttgaactatgcatggaaagtttacataaagctaaatttatagatagctaaggctatgaaaagtattagaagaggatgctgaagatacaaaagtaaaataaatggtgaatttggatgaatcgtagtgaattaattctctaattgcattacttattctgttaataggaagacatttgagcaacttatatatggaggggttcagggcatgatgccccagaatgtggctccttggcctttgataaaacagcagaatgaggaaggtcagtctctgaccttctcccatccttctcccctgaagtaggtcacaagaccctcattagagaggtattctggcagaaagaaacatccttatctctgaaaagacagagaagaatctgaacaaatggccttaacaagtttattaccattacatcctagaccctttgttcatcacactttcccacaactgtccactttgggtcaaacctaagcataaagacgaacaggtttcctgtttctttaggtcttcatttctgaaggctctcatgtcatgtaaagcttatatcaaatatatttttatgttttcctcttgttaatctgtcttttgttacaggtgcctcagccatgaacctagtattggatgtggaaaataaatcttcacccatttataatattcatgactccaaaacatgtcctcttttaatatcccaagctgggttttattccaggcctccctaggggtgtcatgggagaataaatggcaaatttagaattctttatacattatattagccacagatatatatatacatatatatatatatatatatatatatacacatatatatatatatatatatacacatacatatatatatatatatatatatacacatacatatatatatatatacacatacatatataccttttatttttttgagatggagtttcgctcttgttgcccaggctagagtgcgatggcgtgatctcggctcactgcaacctccgcctcctcggttcgagtgattctcctgcttcagcctccagtgtagctgggattacaggcatgtgccaccacgcctggctaattttttatttttagtagagacgggatttctccatgttggtcaggctggtctcgatctcccaacctcaggtgatctgcccgcctctgcctaccaacgtgctggggttacaggcgtgagccagcgtgccaggcctatatatatcttttgttaagaaattagaatttactctttaagatagagttaggcctagtggggtattttgaaaatgtttctgaaaattcgcctataaataaccctgataattttacactgtctttaaatttactggagttctaccaaatgcctaaagcaaataagtgtggatgttaaacattaaaggcaatacttctattccaacattgcaaataactgactgctctgaaccttacttatgaatggcgatacttatatgacatattaaagtttagagtgcaagatgtgttttcctgcctgggacattatatttgataattataaactgatattttaaaatgcatgcatgtctttattatttttaaaaaggtgggtttcaatatgaaaacacctttgtcatgttttccttcttgtgtgtttcatggattagaaagcaatttaagatttaaaaaaatgtttactgaccaacaagtgttttgtttagaaactgtgaaaaatagaattgctgagctaaagcaggcgataaaacagattgagtttgtaatacattacttacaatgtgtgcttaagacatccacaagtaaaatgtgtcttattataaaataaatatacatatatatacacacacacatagtgttttcaaagcacagtgaattaataccaacctcaaatttcattctcgctgcacaaaactaactttaaattacacagtagttttctcagaaaccaatgtcagatattaaagggtctcatccatctataaaatgtaatagttgaaagcatccatctgatagtctgggcaagaaagtgctaggtgaggaggaatgggataaggagaagtgacaggacagtcagaccttggtaaaaatcacttcattggtttaattgaacaatttctctaccatagagtaataaagaaaatatcacacccagtaacaatagatagtttccaagttaaaagaaaaatctgttgcacctcgttggcgtgttctcataacaagtagaacataaagttattagcatgcaccatattccattttaatttctgatctatttatctttctctttcattaaattattagctcctttaagacatatcagtatatctctaaaatctaacaaagaacacagtgcccaacacgtcgtagagaatcaaagagaattttttgttttctgttaacctttatgtttaatcattatgtctacgattcttatttgcataattatacctttaaaatacctaattggtgtgaaatgttttggatgtaccaatcattgttttttgtttgtttgttttttcttgagacagagtcttgctctgtcacccaggctggagtgtagtggcgggatctcagctcactgcaacctctgctttcaaggttcaagcgattctcctgcctcagcctcccaagtagctggaactataggcacccaacaccacacctggctaatttttgtatttttttagtagagatgaggtttcaccatgttggcctggctagtctcaaactcctgacctcaagtgatccacctgcctcggcctcccaaagtgctggaattacaggtgtgagccaccatgtccagccccaatcactcttttaaagcttttctgcattaactcattcatgttacaacaactctgtgatgtaggcactttgatgtacctgatttatccacagttgacagatgaataagcagggtatagatcagaaagtttaattttccaatgtctaactgtgaataagtggcacagccaggatttgaatctaggccatctaagtcatgagccatagcacatacccattacataaaatatctacattattaaaactaaacaatgctttggagtcaaagaatatttctatagttggggcaacaattttttaaattagtcatcatgattataatataaatattattatttaactgtaaatttaactagaggtggcaaaagtggatggctgagagtcgaggcaggtaaaaacttaacctgggtaatagtgaaggtgagcagtctgtcttcagactataaatcattaagtcataggcaacctgagctatcaggagaaagctcagaatatgacaggaagagaagggagctgaaatggaagatgtgaaaggtgttgtagagttcaaacttgcctgagctgatcatataacctgtttcaatgaacatctttatttctgccctcattttgttatttacctagatggttgttcagtttccatgtagttgtgtggttttgagtgagtttcttaatcctgagttctaatgtgattgcactgtggtctgagagactgtttgttattatttccattcttttgcatttgctgaggagtgttttacttccaattatgtggtcaattttagagtaagtgtgatgtggtgctgaaaacaatgtatgttgtgttgatttggggtggagagttctgtagatgtctattaggtccacttggtccagagctcagttcaagtcctggatatccttgttaattttctgtctcattgatctgtctaatattgacagtggggtattaaagtctcccactattttgtgtgggaatctaagtctctttgtaggtctttaagaccttgctttatgaatctgtgtgctcctgtattgggtgcaatcatatttagaatagttagctcttcttgttgcattgatctctttaccattatgtaatgcacttctttttctcttttgatctttgttggtttaaagcctgttttatcagagactaggattgcaagccctgcttttgtttttgctttccatttgcatggtaaatattcctcagtccctttattttgagcctatgtgtgtctttgcatgtgagatgggtctcctgaatgcagcacactgatgggtcttgactctttatccagtttgccagtctgtatcttttaattggagtatttagcccatttacatttaaggttaatattgtcatgtgtgaatttgctcctgtcattatgatatagcttgttagtttgcccattagttgatgcaggttcttcatagcatctatggtctttacaatttggtatgtttttgcagtggctggtaccggttgttcctttccatgtttggtgcttctttcacaagctcttgtaaggcaggcctggtggtgacaaaatctctcagcatatgcttctttgtaaatgattttatttctcctttgcttatgaagtttattttgactggatatgaaattctgggttgaaaattctctctccatatatatatagagagagagagagagtgtgtgtgtgcacatatttgttctctttctctggagaactctaacacatggctgttacaaatcataatatgtacatatttctattgattatctattaaggagtaaaatttctgggtcataaagtgtgcataggtctgacattagcagacaatggtaaacaatttctgaactaggtcaatttacactgtctccaatataagactaccatttgctctagagtctcaccaaaacttgatggcatcagtagtttttaatgtaaaccttgccattgttttgaagttattttaattaacttatcttggtctcaaatatatatttgttgttacctagaatgtaatctgctgatcatcagctaattatgagaatgagacaaggtttctgcttccatagctcagtggataaactgtcttcatggtaaaactgatcagcaaaaatatttctcaccatgctgaaatatgctgtgcttgttcatcacaatctgcctttctggtcttgtggtcaaaaagtatcatgctaatcctaaatgcaatctgttccttgctccatcaagttgatattagataaaaactgaccccaacttgatacctttgctagctccaaattggtgtgctaatgggtgatttggagatttacagtcttttaaaacatgatttttgtatatccccccaaatataaaagctcctcaagctgcttgctacaaacacctcctctcttcactgttgcctgcatgagagtcttctcttttccttctgcagctactgattcactgcaaaatcaactcagactaagtgcagattttaaatagcatggcgaattgaatgatcccagttttaaatatgtcaggaaggtaatgtggagttttctagtacagccattagttttcctcctcctgtgttgcagctgcaaacacattggcattctccaagactgcctcaatatactgtgtgtgctccacccacgattacaaaataattggagtgttaagagaaacatggcgtgaggtgttgggagttggaaggctggccttcaggagcaactctatcttctcccttccaggcacttgatttggtttttccttagttcagattcgattctgaatctgaaaatgttgcctaagccctaattcagaaatcctttgcaagagagctgaaaaatttgctccaaaaaagaaaaaggggagagttctagacagaagtaatcagctacctgtaatcataactttagcatgcttttaccaaaagatgattagaaggatatatctgcttcatcagtgatttttaagaaaaatttcattttcttattgatagaaagacacgtggataagtatactgataaatggctgagactatccagcacactaacaaggtagcttcacacatttctaggtgtgaaaaaagtgctgggaatgttaagtggatgtgactacaacatcccctaaatgagaccagctttctttcagctcttttactttcaactaaaagtgaaaaatgtttatcagctgaggtcaggcactggaaatgagtagtgaatgtaaaatacaagctgtacagaattgttccacatctaaacctgtgggtggatatttgtgcaataaccccaagggtctactttattttaacttttcagcataactgaatggcatagcaagtcacttatctgttcaaaattcatgagagagacagaaaattgataaactcttgcaaaaatttcccagccttctttctaagaagaaccacaatggaaatttgctggcaaaactaaaaaattattgtaacaatattagcaaggggcatgctttagccttcagtgtttaaaaaaaaattcccttcctcatgtacacaacttggtatactcttagcaaagtttgttatactcttagccttttggaaaaggagaaagcttttggtatgcccaatatgaaacaaatttttataatctttttgtaataatttaaagtaagtctatgtcatttcagaatgagcacagtggaaatgaacaatttttacaagtagtgaaatagtcaatacacaaagtattatttattgttgttaatatgtttcaaataatgttaacagttcctagcacatagtaggaacatagaaaatatttgtttctttcaatatcagtcattttttattggcgaccagctaaaatacgctctagctgatttaagtggaaaagggattcattaaatagatattagatgcttctcagggtgatggggaagcctgaataatgtggctcaagaaataggcagtaaacaagtgtctcatattttcagctccctagtcatttatgtatcagtcatttattgcttgtttctttcctaaataaatgatatattctcttttcctgtgtttgaggatcactttgaagatcctcaagatcctcaaacataggaaaagagaatatatcgtttatttaggaaagaaacaagcaaacaaatgatgatgaaaatggtgtccaatgaaaatactaaaacgtatgattacatggtttatataatttgggtatcaattagtttggttaatataaatagacaatgtggaacttttaaacagaaggttaaagccttctctttatcttcacctgtggaaccctcagaacttcagattagtgttaaatccattctgttgtaatgagcacctttctaagaactggaagcaaatctaaaaggaagtcattgaaatcagagggaaaataaaatattctataactgataaaggggaagtgttattaaccagtttaatggatatatttttaatacatagtagaaatgtctttgtttgtagaaatgctctaacaaggactcacttcatttcaactgcatcacagcttacctgtaatgttttgggaacttaaaacctacaattcttcatttaacatacggagtcaacctttatttttaatgccaattcttgatacttaaaataaagtttcaaataaagtgacaataaatgtatcaaaaggtcttcctaggatagatagcttgatatttttcattgccaaaatctcataaacaccaagttgcatacatgaattatattcacacagcatacggaagtttttttttctaaattctctcatttgagtatttttttctcaactactgggccatgactcatgagcatgtggagcagatgtacttggttttatttatctatttatttatttgcatctggtttgcataggacagaataaacacaaaataaggacctaaaattgcttacttgggtgattgaatgcatttatcaggttggtctattactatcttaagagctacacgatacaggccaggcgcagtggctcatgcctgtaatcccagcactttgggaggctgaggtggggtggatcaagaggtcaggagatcagaccatcctggctaacacggtgaaaccccgtctctactaaaaatacaaaaaattagccgggcgtggtggtgggcgcctgtagtcccagctagtggggaggctgaggcaggagaatggcatgaacctgggagatggagcttgcattgagacgagattgcaccactgcactccagcctgggcgacagagcaagactctgtctcaaaaaaaaaaaaaaaaatggagagagagagagctacacaatacaaaatgccaagttatatttcataaaaatttcaatgaaatagtaattatttttctatcattaatttttatcacgatattacaagtgataagaaagaaatcagaaacattttctgccaaagtaaaatgaggtgtatcattcatataataacatgaatattaagcagttttcatatgctagcctatttaatcctcacaataattcagtgtgggaaatagagttcaaggtacccttgaacaacaagggggttgggttgctgacccctcatgcagtcaaaaattcacatgtaacatttgacttcccaaaaacttaacttctaatagcctagtgttgactagagccttatgggtgacataaacatattttgtatgttatatgtattatacaatgtattcttacaataaagtaatctagagaaaagaaaatgttgttaagaatatcataaggaagagaaaatgtatttactgttcattaagtggaagtcaatcatcatagaggcctttatccttgttctcttcaggttgagtaggaggaggaggaggagagttggtcttattgtctctgggacggccaacgtggaagaggcaaataaggtgaaaggagaggcaggagaggcaagcacacttcctgtaacttttactgaaaataatgtatgtataagtggaccctcccggttcaagagtccaccgtattatacttaatttgtttttagagatgaagaaacagagcaattagaaatttgcccaaggtcacatacttgtaagaggtgtatatatatatatatgtatatgtatacacgtatatatatatgtatatatatacacgtatatatatatacgtgtatatatatacacacactatatacatataatatacatatgaaaatatatggcatatattatatagaaaatatatattaatatagatcgctacagaaaaagatttaaggagtttgaagcaatataatcagtgaattttaatagaaaagactcacgaaatgcaacactctaccctactttgttaaggtcaacagatgctcagattgcctttataatgcaataatatgtttaatatttttttcttatttttttagacagagtcttgctgtgtcacccaggctggagtgcagtggcatgatcttgactcactgcaacctctgcctcccaggttcaagccttctgagtagctggaattacaggcatgcaccaccacatccagctaatttttgtatttttagtagagatggggtttcgccatatgggccaggctggtcttgaactcctggcctcaagtgatccacctgcctaggtctcccaaagtgctgaaattacaggcatgagccatcgtgcttggccttgataatgtttaactcatcccactttcatacctcaaacaaccagtaaattagtatactgttccatttgtctgtatagcacctggtattcaagccattttcctaccagagaaaatattctccagagagaatattttttctttgctgaaataaaagttgatgggcagggtcttgcttttctttttttagatctgtatgaattaattttgctttgggctgaatgtttatgtccccttaaaattcatatgttgaacacctaatcaccaaggtgattgggccttgggaagtaattcaattatgagaaggaagccctagtaaatgagattggtgaacttagaaagggcaccccatagagtgcctttcttcttctaccatgagaggatacagtggagaaggcaacgtctatgaaccagaaagtaggccctcaccagacactgaacctgctagtgctttgatcttggatttcccaaccttcagaactgtgagaagtaaatttctattatttgtaagctaaccaggctatggtgtttatattacagtagcctgaacaggctaagacagatgtactctcagtccctggggaagtacaagttgtcctctttccccatttctttcctgtgtatgcactagccttagctctgctcttctttacataataatattacaaaataatttcatttacagaataatatcatttttgttgtcaatatcaattattttttatacaaggaattaaaaaccttgggtaacatttttctagagtcttactttctcttggttatgactttttcacccatttacacgtgtgacacatatatcacatgtgtaaatacgatgcatttgcacactgttgcaaatagccaaaatattccataataagataatttgcctgggcttagtggctcatgcctgtaatcctagatttttgggaggctgaagaaggtgggaggactgcttgaacacaggagttcaagaccagcctcggcaatacggtgagaccctgtctctacaaaaaataaaaaataaaatagcctggtgtggtaatacatacctatcatcctagctactcaggagactgaggcagaaggatggcttgagcctgggaggttgaggctgcagtgagtcacgttcatgccactgcgctccagcctgggtgacagagtgagactctgtctggggcggaggagggtggaggaaagaaagaaagtgagaagaaaagctttatatagcagagttgtctccatgttttctgaacactgtgcatcccagtctaaatcagtaatcatattgtaaagttcctcaggacctgactctgtttcttaagcagaaaataaatgtattgacatataaagggtagctcagaaaattaaagaaatatttgaagaacagttgtggggctggacaaatataagagcacttcaggcatctagggaatagaacattattattaaattatgtaacacactctctatgggataaatcagctaaaatgatcttcagtatttaattactccactccaggttagatcctataggaagtgcaactggacaaacatgaatcacttgcccacctactttctaggaaagcacagaatctcatgatggataattttgctaaatggtccatctatcaaagtgaaattgggagcttttaccagaatacaggaaaagtagattggcaaaagcaacagatttctattacaactgttaacaattttaaaatagtttcgttacaaagctgttgaatccacaacacagctgcaatcttagatcaatattttcagtgtcactcccccacctttaaaaaatctgaatatgacatcaattcatactttagacagttaattagattaagaccactactttattgtggcagaaaaataaagtttaatctgagattttagacgtcttcaaaattagaacagggaggtttggttgatctttgaagaattcattcctaaggtaagtgaaaaataacatctcaatacaaataaatgtatccatgaatgaaaggttagcatgtactcagtatctcaaccctttgttggaatgtgaggaaggctacatccttacagatctgacgttctgagactctcagggcacaggaactgataatactaaggcatatcaggccttcttgctcagtgcatctggggaggctattgtagttctaaggttataaacatgcaaacatatactgtcttcttcaaagctgcctcccccttgtctctcttattggcagcagaaagtagagcagagctacaaatcatgcacagcaatctggagatacggcagggcagcctcgtgtcggagtcgtaaatctgacaccctggccaatcagtgccggcctcattttattcacggcatgttcatcgtgcaggcaataggagcgggaggctgctttctgtccttggcttctaaccacatggttgcatcctggtgtgtttttctatttgtgtatatttgagagaacaataagttatgtttatgctttcctttcaagaaggagagtctatatttttcatccttggacttaatcagagcctaatttttgtaaaaaattcatttacttgaagtacaaagctattgtgtgttgcacttggggtttctttttgtgttgttttgataaagaaggattccaaggccaaagtttcccagtgtcattttaagtaagacctgcaaaatattcagggtcttaggtgaaaaaaaaaataccgagtagaaaaagtactcttccttaccatatgaccactttcagccttgctaggtggaaggaagtggctctgtcaagtccatattccagcagggctcaaaatttacatccctttgcatatttccattaaaaataatataagcttccaattcaaatgtataattttgcataatcattgcttcccatcttctctttgggtcggctaaaataaaagggaggagaaagcatagtttacagaaagtaagctttaaatggttgagccatttaaaatcaccatttttgttagtaaaatatagttcaacactgagtattttgtatgtttcaaagtaatataaaattattctatactaacaatgaaaattagagaataattatgactgaatgggaactaaaaactagatgggaataggtaaatggataaacaagtgtgaagaaagctacacatctcaaggttggtcttggtggtcatgactgtaatcccagcactttgggaggctgaggcgggtggatcacttgaggccaggagttggagaccagcctggccaacatagttaaaccccatgtctactaaaaatacaaaaaaattagctgggttcgggagtgcacaactgtattcccagctattcaggaggctgaggcataagaattgcttgaacctaggaggcagaggttgcagtgagctgagatcacaccactgcactccagcctggatatcagagtgagaacctgtctccaaaaaaagaaagaaagttacatatcccagaatatgggagcttggaaggattttggaatgagtttgtttaatgggtctctgaaggctatggagtcaaagacagtaagccaattagagggcactgggcaaacaggccccaaatagtaatcatatagaactaagccaagtagcaatcctatacccactcttagactataggcatttgttatcctcaagggaaactccaaattgggttcttctgcaaagcaataaacagtttgaggaaagttaagttccgagtgtgggtgttggttctaacagtaagatcatggtctgctacaatttggatgtttttatcccctccaaatctcatggtgaaatttaatcttcaatacagcagtgttgggaggtgagacctaatgggtaatgtctaggtcatagggctccgtgttaatgaatggattattatttttatttttataatggcaataccactaaaaaataactttcaggagtggattctttctcttccactttctgccacatgaggatacaatgttaatctctgtttgttcttgcaccttcttccacgtgaggatgcagcaaaaagccctcattggacaccagatgcaggtgccttgatcttggacttgccagcctccagagctgtgagaaacaaatttatgttctttataaattacccactctgttatttttgttacagcagtacaaaatgcactaggatatagtcattctgccatttggtggaaagtgtaatagctggttagctaacaggtccaggtcagacctcataaaacaccatgtacacagcctggtcaaatgtccaacttagtaaagaaaatcaaatagaaactgtactactgattaaagcaacaaagaaagtacctaacattcttatttcttacagttaagctgtgcttatgaaaagatctagcagtatcaagaaactcagatataagtctactctaaaagaaaacaaataactctgcacacaagtgagaacttagtaaaatccagtctataattaaaaatttgagaaagtattgcattcctaaaatagaaaaagtttggtatgtaaaaaaaaaatcagatagcaacaaaactgtcccagtttaaaatactaagggataaatttttaaagaatggggaaaagataaaaatacaaataaaaatataagatgtaaaggactgacaaaggaggtccctgagtaataagaatcatatatcaaaaaaaagccaactgtcaaataaattatgaaagaaaatttcctagagctgaaaacaggtattaaaatttagattcaaagggctttaaaggcccagaaacatacattttttaaaaagtcaatcatccttaatcatatctttatgaagttttagaactgcaactttttgaaggaaaattattctcaacttagaattctataatagtcagactacaaatcaaatgtaaatcttaaaaaatgtgcaatacgtagaataacattgggcctttgttttaacaaaaccattctttaaaagttacttcagagcttggcttggtagcacactcctgtaatcccagctactcaggaggctgaggcaggaagattgcttgagcccaggagttccaggtggcagtgagctatgatcacatctgtgaatggtcacagcactccagcctgggagataaagcaagactacatctctaaaaataaataaagaaagaaagaaattacatcaggatacgctctggaaaaatcaaagagtatttcaagaaaaggggaacacacaaggtcaggaaacagtggatccaaccatcagagttatgatgagaagcactgaaatggcagctgaacttgtgacctaaatcacaaccatgtggattaaaacaagaggaagcgattcttcatgaaagaggtttacagaaaacgtgaaactacagaatggctagtaagatcaaacatttaggaaaacacaaatacataaggcaaatcatgactaaaaaaaagaggaaagaaagaaaaaaacagttataaattcttggaaaaatgtaacatttcacaaaaagtcatggtccaattttgaagcaatgtaacctgcatgatggtttcaggcaattatgaaagatgatttattttaatgtgatgctaagaaaattctcctgtgtgtgacacaagagtgcagaaattggatcagagacaattaaatgcaatctacctataatactttcttggacaacaaaaaatacttatataattttaaaaagtaaaacagactttagcattaacccaaggacagtgtgtgttaagtctgcttgcagttggaatataaagtaacagttaatatgcaatacctcaacaatataaaagttgaagtgtgactgacataagatagtgtatttacatggaagagagaggagaaggaaagatcatgccaagagaaaatactgtgttaatagtcataatgtaaataattaaaattgcagttgaagtattttaatgttaaaattttaaccaaattataattcattacaatatatttatatgtattattatatataatataatgtataatgtctatttttatatatatagtagtattggagaagaaaatttttaaaagtagtatgagcaaatcaaatccttattgtgcacactgggaagaaagtagaaattttgtacaattgacagatcaagaaatagttgtataattatattacttaagatttttagggtttttcattctaaacagtggaacacaagttgaagaagagggaggcaataaactgtagctttttaatagtgagtttttctgtacagttttgattagttatcagggccatctattactccagtaaatattgaaatagaaaaaaaaggatggaattatatgaaaaaataataatggcctttattgctttatggtgagattacagattttttaatctactttttgcattgaaaacacttgcaataatgtatatatatatttttttgatgataagaaattcagaagtatccacaaataatttttttaaataatatttcattgtctacaatgtgttgtgtaatttgacagaaatttttatgctttttatctattctgtgaaatgatttatccatttgcgttcccacatgaataaactgaggctcactgaaactttttaactaacacaggttcacataaaaatatgccattgcttcaagcctaacttttggcttctcaaaatagctcaccacactctatctccaaaagcttatgacatgtgtagggatgtgactagtaatcttacaaaatagggacctgaaagatttactgcaatttacctgaatgaaaactgatttaacactcactacccacattaagatgattttttaaaaatagctgttaccataattaacccagatttataaatcatctctaaaaaaatctggccccattgatccaattggtttctgcacactcaattactaaagctgaacattctaaatagacttgcctgcccctttgtggttctgttgtgttgaccctacccttgttaaaagtatgtattctttattagactgctcatctttaaatgcctctcttcagcatttgttagttgtgtgacactgatattcccattttgagaccttcattcttcaactataaaataaaaatttaaaaagtactgcagttgaaaatgtcagttgtcttccaaacatctattcatccctttttcattgccaacagaaccccaatttgaggtctggaaatatgatcagctaaatgtatactacatctttctggctgccttaaagctaagggttgccatgtaacagttccaaccaacaaggtgtaagtggaagttggctgtgggtttttgagaaagcttactctttcttgatatgaacaacaaaaaaagaagatatggtttagactgtcctacctatctctgttttacttgcttcaaataaggacgcagtgcaaaaagccaggtctgcaatattgtgagcatgtggaggtaggtgtagtggaaaggacaagagaattgcaaaagttctaactttgatataaacaagatgtcagctgcttaacctttaaattttgtgtgacataagaaaaaataatgggtctaagccagtagaagtggccttctgccatttgtggcctaattaattgctttctctctctctcttttttttttttttgacaggattttgctctattgcctaagctggagtgcaatgacatatgattgcttactgcagcctccaactcctgagcttaagcaatcctaccacctaaccctcctaagtagctgggactacaggtacttttcaccatgtctggccaatttttaattttttttattttgtttttgtacagacaatgtctggctctgttgcccaggctgatcttgaactcctggcctcaagccatcatcctcctttggcctcccaggtgctgggtttacagggtgactcactccacccagatgtggccaaatgaatttctaatggattctaatgtctttttcacaggattaaatcaaacaatacatataaataattaagattagggccaagtacatagtgcataataattattggctacaatggggttaaaggaggaaattttaacatggcatagaaatttgcaccttgaaattcagcctttttatctcattgctcaggaaacaaatgttcagagcatgaaatcacttgatcaagataattcatgtgatctttatttctcttcataagttactattatgaaatgtgctatttattaatcatctgctatgtaacaggtgttccacaaaagtccgggtatagagtaatgccctcacaaaacttccttatagtgtcacacattctgggtctaaaacttgaattaaacccatttaagatttaattacatcaaatattaaaaagtgttgatactcaggtttagcttgaatcttagcagacaggatatggtctaattaaaccactaactacatctgctatttatatccattaactttaattttatagtgtagttcatagaaccaaagaaatggctgagatgccaggcttggttagggtagaaacaacggctaatccaatcatccaggtcgtaggagtcagcctaacctcagcattgacactagactatatcaactccaactcttgttttttctgttcttgaattcttccacttgactcagaaactagaaggggctggggaacgggatggattgttctaatttgaatgacatattcactccttggctaagagaggtacatcaccttgactgacagtccaccatattgctcacaatgggagtgaagttactccccaggaggagattagtgtgccacctccaaaagaaagtggaatgcagaacaattacctatgcaattactgaaaccagagctctagcaaaaagtataaaataaaaatgagagactatggaacttagataacaccctggttctgaatgggaggggggtggtagagctcaaaaagaaaatattagaaccctagccaagtcccagaattaccttagtcagtccctgtgtatcagcctgtggtattttgtgacaggaaaggaaaaacagtaaccctgccttcttactctttttggtataccttaccaattctcttttatattccaagaagttcttgcctgaaatatgtaacagttaagtgttgtttttctccttgcttatattgactttgtgaaaagagcttatgaaatgtagtgttgctcagtcttagaaaactaggccaggtatccaattagcatatctctcttgctcacaggactatcaggatgattaaggagtgttccttctagcagagaaaaaggtcttctgagctgggagtcagtttgacagactagtctttcattgacccccttcagctctcctttattttacccttgatttttaaggagggtgcttttactgttctttatatcactcttgctgtcattgttactgcagttgagaatgctttgattccccctctgtgtttaaattctttatcttcttctatttcacacattcaatgttgtagccaattgccaattctgtttgggcaattcaatgatgcataacacttttaagcagagtataactgaaagggcaaacttttgtaaaagattattattaaagataaacactttggatggatggatggatggttggatggatggatagatggatgccacaggttctgtatactgtgcagaaccccttatgctcatttctcatttctgagtgtcttttctcctgtttcagtgtgtcattgatctcaatcagctgtacctcaaagtcatatttggcacactctcctagggcaactgggacacttcccatagtcatgggcaaccagaagtgcttgggagtttacatcagtctctcaccttgaggacttcaatcagtggctgtatgttgtggaagtataaagtcccaggatctgatgagatcagaatgaagctacatttaatagggcttggcctgaaatcatacccttgcttggcttcttccccttcagtgtcatgtgcaaaatcccaagaaaagaactagttaatttgtctaagaacctcagaaaacactggcacagatagtgaagaagaggaaaagtagtataagatgaagttggaaagagacttaagagtcagatcatgccaagacttataaggagtctgagtattattcaaagcatcgcagttcacatctactagccttttctccttcataggaaaaactgcaatcaagaatggtagccacaatgggtagttgccatggtagtgaggacaagtagccaatatttacggtattgtcattgctggtaaaggaagcatagggtatacaactaattttctaatgcaattgttgcaattgttagccaggttgtaccaaaggaatcttcctattcttcatcacaaaataattatccttaaaaagagcttggaatcaagaatccagagatatagtgctaatattcaagagttttcacattatgctaaatttagccaaatgttgcaaaatcatggttaagttgacataggcccctgtctaagctgcaactcttggttgaacacatcaataatggtgtttaagcatcccaaattcgactgatggcagagaagccaaattgatcattttgatgtaaaatgaccttcatttgcttctgttatggttctgttctctagggaagaacaaataatttctaacctatgcttagctaggatgtgacactttattatcaatttattgataaggattatggtgtactatagattattatttatttatcttatgttagtttatcaccacttataatctgctaacttttctaaaaagtatcaatagaattagttttattttttcattgcattaagaagcacatttttaaataatctgaaattgtttttacataaacataatttatctaagatttagattttaataacactacattttgttagtgcagacttggcctccatgcttactaaaacataggtagtttaattagctgatcacaatatggaatatgactattagacgagaatatgttttaaaatttgttttaatatcctgtaagagaaggcaaatcaacaagcatgtggagagaaactcttttcttgatctacttacttttaaatatattttggcacataggaccattattcacaggatccaatttatttcaacttacaacttattagtaataataatatatgtagctttatatctttatgtgaaaatcccaactatgacttaagtgtgagtgtcatatcctgcaatttcacagatacttagaagtgatagatgaaaatcatatatattcttcttgtttactgaagatatttaacaccagaaaaagattaaggaaaaagaaacactctccatatgtattcatacatttttaatgagaaaaaaagaaataagctctgtcaaagtgctatttgtagctatttccaaatttaattttatgttttaaaaagtttttgaagtcccacctaagataacatctgtgaggccagaaataaataaaatccaagtgtatttaaaagaaactaaggattaaaaggtgagcagaacctgaagtggataaaaatttgtcttttcaatttacttggtgttcattttgggaaattagcctcgtgacccccagcctaaatgacatcatccagtgaggttgctaaatcagtgtgataagacccctggaattgaggaagtttcaagaaaggatgctgaaaatctaccatacattgagttactgtagattaatggttcatggcattatcttatttactcctaagaacaactgtatacattagatattattatcttcattttatagaagagacaccaagtgttggagaggctaatgacttaacatagctattaatcagcagaggtacatttaaaatctgaatccaaatccagaaatcacaaagctagcatatcccctctagtaccagcctggtaattgtgatttatgtgcttaataagaaatcagatctgttttcatgaacactatgtttaataaatcatcttattgaatcagaggtcctaactgtctagcctgaactaaccaactgggttctagtaatcaagcaattaaagacaacagtttggaattgtaggtgacataaggcaggtaaataagaaggaatcattcctggttttgcatagccacatacagagcacagtgcctagagcagagcattgcagatccattgaatctgcttttaagatccatctagtgtgcctagaaaagaaacaggaaagaaatcacaaactgttaacagatagaataatttactaaaaatgtcatactgcctgtcactggtttattataagtagcataattcaaatgaaacctacatgggctccaaaatgttacacctagaatacagcaagatttgaccatgactaccctaaatgatatatgatcagtccattttcctttgctataaaggaatgcatgagactaggtaatttataaagaaaagaggtttatttggctgacagttctacaggcagtgcaagcatagcaccagcctctgctcagcttctggtgaagcctcaggaagcttttattcatgacagaaggtaaacagggagcagacatgtcacatggggagaaagagaggaagagagaaggcaggccaggctctttaaacaaccagctctcacgtgaacccgagctcactcattactgtaggaagggcacaagcaattcatgagaatctgacctcatgacccaaacacctctcattaggccctacctccaacactggggatcatatttcaacataagatctgtaggggacaagcatcaaaactaaatcaatatagttcaccaaacatatgcacagtgattcttagtcaacatcaggttggcagatctaccctgtgagatttatctagctatttaataactgccaacatactactttttaatctgactttaaatcaaatcatcacgtatatcataccagaaagcaaattagaattacatgttattaatttaccaaggaaagccatgtgccaaaaacatcttttggaatacaggaaaattgatcagaaatttaacttctaatttaatattggttccccatttattggtagtaaactataaatgctaatatccgatggtaggattaggatgagactctttgacctagaacaagaggatgaggcgtttgcgctcagctttgtagaaagctttgtagcttgggaacaaacaaatgctcatcattagcggttcagtttcttcaacttctctttctctttttcttcgcctatcaatcttataaggtttgtttctctcctgttccgttcaaagatctttgctctaataaaaagcacaatttaagaagttttctcattctggatatactttttactgcccaaagtacagcacagagaattaagttttcaaaaaccaagtgatatagaagaaagaaaaagagattaaagaacatgaaagtgctacagagactcaataaaatatatgtagtttttttaactctgaattttcctcttttgaagacaaccaaaatcttttaaaacacattatcttaaactattttttatttgtatcagttctccattaagttatgaatatatatttttaaaacagctttggaaaaatacattttctgttttattttgttctacaaaatatagatagaatacttctccgaaagatactattttcctagtacacaggatatgaaatctcagaaaagtataaaaaaagaatacaaagcttataggcttgtgatgggacttaggagaaaagtttggacaaagggacaagcatacaatgcatcttccttctcttcagacagaaacagtattaataccaaaagaatatgtaaaagtgagcaattccctctgtattcacacaatccaagcgagtgtgaatgataatgggatcttgaatctctcgtaccagacatcagtaaaaaaacaactatgtcctgtcagccttataacaaaggagcttattaagataaatgatacttttaagataacatctaccataatatgctacacttggtattcaaatgtaaaacaagccaaagtcaatatatccattgttctccctcttaattctttgccttaatctccttcacaacaaataaaattgtaaagcaaatcaactgctcaaaactaacagtgccacttgtcctatgtcaaaatttgtctaggacagtctaaattcaaatattcaattcttctatggacaatgcaaatttatttatatcatgcttccttttaacaaccttgataggaatttcaaaacactggagattaactgagtaaattatgattcaactctataatatatagtatgcaactaaaaagaatatctaatgataaaagaaaatatttaattattttgctaaatgcaaaaagcaagtttcataattttatattcaatatgtctacattttatagaactatacagatataatgaaagaccacaaggtcatatgccaaaatattaatagtaattttttaaaatgatagacttccaggtatcttatatgattgacttgcatttcttttgatctcaatcagagtagttgaattattttcttgtgaaaatgtactatccttgtttttgtttctgtatgttttctctatgtaaatcctagcttttcaaataaccattcaaattcttatgctttgtattttattttcctgaacataccagctaatgtaaaataatctttctttccaattcttgaaaccaaatgtaagctccttaagggaagaatctataacaatttgtacttcccacagcaactatattagcagagaaaaatgatttggtaaataaatacctgtgagattaaaaagaaaatcttaaggatgtaatgagatttgcatacacacagacacactctcacactttctttaagaggaggctcttcagtcctatttatttcacccaactctcatcaagttgcagactctgaaccaaaaggaatcttaggaaccctccatactgtgctgatttctcctccgtaatagtctctttgcatccagctgggcttgaatatcttcagccacagaaaaatcacttaacatatggagctcattctattgctacatatgtcctaaatactaaaacattattttaatgcttagccacaacacacacatgcttaaatttaaaaaaaaaaaaagtcagtaccatcccctaggtaatcatgtttgtaacactttaatgagtttaaggcctgagctctaaattataatcaaatgttaagttaaaaaaaatgaagcatatagaattttctgctttcttcatgttgattgcttccttatacttccttattttcaatatgtatcttacttatttaaggtatattttaaaatttaatgtgatggcagaaaacaaaatatgaaaacaatgcatactattatatatttatcaagatttgtgtaatttagaccatcatttgaatcttacttcttatatttcgatattttaagaattaagcttatataggtaaagaccaaggttacagttttactataataagttatataaaaaacaaatatattgaagcagagcacagcaaacttttcctgtaaaggacctgatagtaaatattttcagctttgggaactatacaatccctgctacaactattaatctctgtcattatagggcaaaagcagccacaaataacatgtaagtgaatggcgtgtctgtttagctgtgttccaataaaactttatttattaaaaacaagcaagatttgaatttggcctgatgtaaacatagtttgataatccctatactattgggattactcatgccattgtcctaatgaactacatagtttaaatctattccatcaataaggctatgtgcatcaggatttattcaattgaacgtgtatttgttaagctcatcatataagctcagcattgtaatcaatcaggctttatacagtcttatttaagattgcctagaaaaacagactaaagattatgcaacaaatttgagacatccaagtggcaaaaccaagtaattcaacatgaaatatttatttgaggatatgaaaaaacaaatgtacatgcgtgtgtatgcacacaggcacctgtaacaatagccttgttttcctctcttaggaagatataaataaaagcttaaatggctttcatgagagtagaagagatatcatgttatttcgttctctttttaaagcattctagaataaataaacagtagttgccagaggacctactataagcaattctggacttgacccccaaaaatgttacctctcaaaatatttctgaaggatgagctgaaggggagtaaacagtgacttaaaatctgatagtagacacttttcatgatccttgaacaaggatctatcattatgccttagtgtacctctggttcataactttgacacacacaatgattattcctcagtggtaatgaaatatttattaaatacagataatatttgatagggtttagatatctgtcccttttaaatcagctcatgttgaaatatagtccccagtgttggacgtggagcctgatgggagatgttcggatcaggaggtggatcactcatgaatagccttgtgccatctttttggtaatgagtgaattctccttctattagtttacctgagagttgctgtttaacccattctccccaagaatattcgctggtggtgcttgtggctgcagagtttaccctgagataactcgtgggttacagttctaaccttacccccaaagtttgccagggaatatctcaattttattattattttcacattgctctaatatatcaacttgggaaacaaaatacatcattctatttatagcattctgtttttagtagtggtatttctatttacaaaatatagtaattctcaattgctgaaaatgtcaaattctatacaacatagaattcgacattttctgtgttgttccatgcttcaaaatttgaaatttactaacagataaacattattaaatactgatcgtcatatacatttctattacattaagattagagacaagttctgtttacaaataactccaagaacagtttttagattttattttcacattgaaaatcaattagatttgctcctacctcaaagagcatgtttgtgtaaaattaaatgagtactggcagtgagctgcactttttttttctaaatgagaaatgggttaaaagagtgttgcacctcttcctctcactcattccctttcttgtcatgtgacatgcctgctccctctttgcctcctgccatgagtaaaagctgcttgaggtctcaccagaagctgagcagatgctggtgccccacttgtatagcctgcagaactgtgagccaaataaccccctctttttaaaaaataaattacccagcctcaagtattccttcatagcaatgcaaaataaactaatacagaaaattggtactaagagtgggctcttgtataaagatacctgaaaatgtggaagcatctttgttactgggtaacagtcagaggttggaagagtttgaaggtctcgaaagaagacaagagagaatttggaactttttagagacttgttaagtagttgtaaccaaaatgctggtagaaatataaacagtaaaggccaggctgatgaggtatcagatgaaaatgagaattttttgaaaactggagcaaaattcacccttgttacatcctagcaaagagcttggctgcattgtgtccatgctgtagggatttatgggatgtttaacttaagagtgttgacttaggatatctgacagaagaaatttctaagcagaaagcattcaaggggctgtgtggctgtttctaacaaactacaacaagatgttggaacagatgtattacttaaggttaaaaattataataaaaagcaaagcagagtgtacaaatttggaaaattcataatctggccatgaggtagacaaagaaagacagttttcaggagaaaagcagaagcagctgagaaataaccaattgctagagagacttgcatgactaaaatggaaccaagtgctgatagccaagacaatggaaaaaagaccttgaagacatttcagaaatcttcaggagagtccctgccatcacaggcctagaggcctaggaagaaagaatgcttctggggacaatgcctgggagaccactgctctgcaccacctcaggagagtgtgccctatatcctggctgcttcagccccaaccaaagctgaaagggcctgggtatacctaagctcccattatggagagttcaagccactgtaagcattggcagcttctacatggtgttaatcctgtaagtgcacagagcacgagagtgaaggcttagtaacttccacttatatttcagaggatgtattggaaaggctgggtacctaggcagaagcctgctacaggggtggagcccttgcagagagcctatactaggatagtgccaaggggaaatgtggggttgcagcccccacacagagtcaccacccgggcaatgcctagtggatttgtgaaaatggggccaccacctttcagatcccagaatataccttgagcctggaaaagtcacaggcattcaactccaacccgttacagcagccacatgggcttcaccaaataaagccatggaggcagagctgcagagctgcccaaggccttgggaagaccacctgtcatttttctccaatgtagtagtttctccaataacccatggtacctcccaccaagacctgagtcctcaaaatatctattgaatggttgtactcttaggggtgtagttataataataatgatatacttcagtattaaattttaaattttatggagtaatgataagcaataaaaataaaacaatacttcttccttgtttgctaaattacaagtagcaagccattcaggggaggagccaagatggccgaataggaacagctccggtctacagctcccagcgtgagcgacacagaagacgggtgatttctgcatttccatctgaggtaccgggttcatctcactagggagtgccagacagtgggcgcaggtcagtgggtgcgcacaccgtgcgtgagccgaagcagggcaaggcattgcctcacctgggaagcgcaaggggtcagggagttccctttcggagtcaaagaaaggggtgacggacagcgcctggaaaatcgggtcactcccacccgaatactgtgcttttccaacgggcttaaaaaacgacgcaccacgagattatatcccgcacctggctcggagggtcctacgcccacggagtctcgctgattgctagcacagcagtctgagatcaaactgcaaggcggcagcgaggccgggggaggggcgcctgccattgcccaggcttgattaggtaaacaaagcagcctgtaagctcgaactgggtggagcccaccacagctcaaggaggcctgcctgcctgcctctgtaggctccacctctggggacagggcacagacaaacaaaaagacagcagtaacctctgcagacttaaatgtccctgtgtgacagctttgaagagaacagtggctctcccagcatgcagctggagatctgagaacaggcagacggccttctcaagtgggtccctgacccctgacccccgagcagcctaactgggaggcaccccccagcagggacacactgacacctcacacggcagggtactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacaaaaactggaaactctaagatgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaagggaagtctagagaaaaaagaataaaaagaaatgagcaaagcctccaagaaatatgggactatgtgaaaagaccaaatctacatctgattgatgtacctgaaagtgatggggagaaaggaaccaagttggaaaacactctgcaggatattatccaggagaacttccccagtctagcaaggcagcccaatgttcagattcaggaaatacagacaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaataatcagtaccagccgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaaattggataaagagtcaagacgcatcagtgtgctgtattcaggaaacccatctcacatgcagagacacatataggctcaaaataaaaggatggaggaagatctaccaagccagtggaaaacaaaaaaaggcaggggttgcaatccacgtctctgataaaacagactttaaaccaacaaagatcaaaagagacaaggccattacataatggtaaagggatcaattcaacaagaagagctaactatcctaaatatatatgcacccaatacaggagcactaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctgcagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaataaagatgttctttcaaaccaacgagaacaaagacacaacataccagaatctctgggacgcattcaaagcaatgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaagagagaagaatcaaatagatgcaataaaaaatgataaaggggatatcaccacggatcccacagaaatacaaactaccatcagggaatactacaaacacctctacgcaaataaactagaaaatctagaagaaatggataaattcctggacacacacactctcccaagactaaaccaggaagaagttgaatctctgaatagaccaataacaggagctgaaattgtggcaataatcaatagcttaccaaccaaaaagactccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgaacaagtgggcttcatccctgggatgcaaggctggttcaatatacgcaaatcaataaatgtaatgcagcatataaacagagccaaagacaaaaaccacgtgagtatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcgaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccacttctcgaggaaataaaagaggatacaaacaaatggaagaacattccatgctcatgggtaggaagaatcaatatcatgaaaatggccatactgcccaaggtaatttacagattcaatgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaagaactccctatttaataaatggtgctgggaaaactggctagccatatgtagaaagctgaaactggatcccttccttacatcttatacaaaaatcaattcaacatggattaaagacttaaatgttagacctaaaaccataaaaaccctagaaaaaaacgtaggcattaccattcaggacataggcatgggcaaggacttcatgtccagaacaccaaaagcaatggcaacaaaagacaaaattgacaaatgggatctaattaaactgaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcgaaggacatgaacagacacttctcaaaagaagacatttatgcagccaaaaaacacatgaaaaaatgctcatcatcactggccatcagagaaatgcacatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgtgtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagtcatcaaaaatgatgagttcatgtcctttgtagggaaatggatgaaattggaaatcatcattctcagtaaactatcttaagaacaaaaaaccaaacaccgcatattctcactcataggtgggaattgaacaatgacaacacatggacacaggaaggggaatatcacactctggggactgttgtggggtggggggagtggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaataaataaataaataaattacaagtagcataaactaagatggatgtgtagatagatacataggccccttgttatgttttcttatctttcagaacaaaaaagtagacaagtttcctagtcaagatattccttagctacagcagtcacaggaaaattatagcacatgttacctctaatcatatatctgtctatagaatgattcatcctgcatgtttctaacagagcgatcattgctcagcacaaccctgctcatttaattactcctcagaatcctcaagtggctctcaatacttccaaaatacaagtcaaatcaggtttgcctgtcttccaaactcctcaacaattcaactctcagccatctttcattttgaaacacaggttgttttggtagaatttacataaaataaaatttactctttttgatgtataattctatgagttttactaacgtatatagtcatgtgactacaaataaaatcaatatatagaacattttcatcacctgaaaatgtaaccttctgcctctttgtaggcattcatctccctcagtcctagccagtggcaaccactgacttatttcttgtccttcaacttgactcctagaaactcatgtaaacggaatcataaaggatatagccttttaagtacgtattgtttcactaacttaatgtatttgagatttatccatattgttgcttatttagtaggttgagcctttcactttttattgctatcattccattatatggataggccaaagtttgtttaaccatttgtccattgagagatatttatgtggggatttgctgacaagatggccaaataggaaaagttccagtctgcagctcccagcgagatcgacgcagaaggtgggtgattcctgcatttccaactgaggtaagcagttcatctcattgggactggttggagagtgggtacagcccgtggagggcaagccaaagcaggatggggcatcacctcacccaggaagcacaagggttgggggaattatctccccgacccaaggaaagcagtgaggcactgcaccatgaggaatggtgtgctctggcccaggtactgcacttttcccatggtctacacaacccacagatcaggagattccttctggtgcctaagccaccagagccctggatttcaagcacaaaactgggtggttgtttgggcagataccaaactagcttcaggagttttttttcaataccccagtggcgcctggaacaccagtgagacagaatcgttcactcccctggaaagggggctgaagccagggagccaagtggtctggctcgggggatcccacccccatggaggccagcaagcttggatgcactggctggaagttctcgctgccagcacagcagtttgaggttgacctgggatgctcaagcttggtgtggggaggggcctctgccaatgctgagacttgagtaagtggttttacccttacagagtgaacaaagctgcagggaagttcaagctgggcagagcccaccgcagctcagcaaggccatggtggccagactgcctctccagatccctcctctctgggcagggcatgtctgaaataaaggcagcagccccagctgcttatagataaaacctccatatcccagggacaatgcacctaggggaaggggcagctgtgggcgcagcttcagcagacttaaacattcctgcctgacagctctgaagagagcagcagatctcccagcacagagtttcagctctgctaagggtaagacttccccatcaagtgagtccctgacccctatgtatcctgactgggagacacctcgcagtaggggctgacatacacctcatacaggagagctctggctagcatctggcaggtgcccctctgggacgaagcttccagaggaaggaacaggcagcaatctttgctgttctgcagcctccactggtgattctcaggaaacagggtctggagtggacctccagcaaactccagcagatctgtagcagaggggcctgttagaaggaaaactgacaaacagggatagcatcaatatcaacaaaaaggacgtccactcagagaccccatctgaaagtcaccaacatcaaagaccaaaggtagataaatccactaagatagtgagaaaccagtgcaaaaaggctgaaaattccaaaagccagaacacctcatctcctccaaaggatcacaacttctggccagcaagggaacaaaactggatggagaatgagtttgacaaattgacagaagtaggtttcagaaggtgggtgataacaaactcctccgagctaaaggagcatgtttaacccaatgcaaggaagctaagaacctggaaaaaaggttagacaaattgctaactagaataaccagtttagagaagaacataaatgacctgatcgagctgaaacacagcattaaaacatcctgatgcataaacaagtatcaatagctgaatcaatcaagcagaagaaagcatctcagacattgaagatcaacttaatgaaataaagtgagaagacaatattaaagaaaaaagaataaaaaggaatgaacaaagcctccaagaaatatgggactatgtggaaaaaaactaaatccacatttaattgttgtacctgaaagtgacggggagaatggaatcaaattggaaaacactcttaaggatattatccaggagaacttcaccaacctagcaaggcaggccaacattcaaattcagaaaatacagagaacaccacaaagatactcctcaagaagagcaaccccaagacacataattgtcagattcaccaagattgaaatgaaggaaaaattattaagggcagccagagagaaaggtcgggttacccacaaaggaaagcccctcagactaacaggagatctctcagcagaaaacttacaagccagaagagagtgggtgccaatattcaacattgttaaagaaaagattttcaacccagaatttcatatccagccaaactaagcttcataagtgagggagaaataaaatcctttacaaacaagcaaatgctgaaagattttgtcaccaccaggcctgccttaccagagctcctggaggaagcactaaacatgcaaaggaacaactggtaccagtcactgcgaaaacataccaaattataaagaccgtcgacattatgaaaaaactgcatcaattaacatgtaaaataaccagctagtgtcataatgacaggttcaaattcccaaataacaatattaaccttaaatgtaaatggcttaaatgtcccaattaaaagacatagaccggcaaactggataaagagtcaagacccatcagtgtgctgtattaaggagatccagctcatatgcaaagacacacataggctcaaaatacagggatagaaaaagatttaccaaacgaatggaaagcaaaaaaaaagctacggttgtattcttagtctctggtaaaacagactttaaaccaacaaagatcaaaagagaaaaagaagggcattacatattggtaaagggaccaatgcagcaagaagagctaaccatactaaatatgtatgcaccaaatactggagcacacagattcataaagcaacttcttagagacctacaaagaggcttagaatcccacacaataataatgggagactttaacaccccattggcaatattagacagatcaatgagacagaaaattaacaaggatatccaggacttgaactcagctctggaccaagcagaactaatagacatctacagaactctccaccccaaatcaacagaatatacattcttctcagcacctcatcacacttattctaaaattgagcacataattggaagtaaaacatgcctcagcaaatgcaaaagaatggaaatcacaacagtctctcagaccacagtacaatcaaagtagaactcaggattaagaaactcactcagaacagcaaacaacatggaaactgaacaatgtgctcctgaatgactactgggtaaataacaaaataaagacagaaataaagatgttccttgaaaccaataagaacaaagacacaatgtacaagaatctctaggacacatttaaaagagtgtttagagggaaatttatagcactacatgcccacaagagaaagcagaaaatatctaaaattgacacactaacatcacaattaaaagaactagagaaggaagaacaaacaaattcaaaagcagcagatgacaagaaataactaagatcagagcagaactgaagaagatagagccatgaaaaatacttcaaaaaatcaatgaatccaagagttggttttttgaaaagatcaacaaaatagactgctagccagactaatagagaagaaaagagagaagaatcaaataggcacaataaaaaatgataaaggggatataaccactgatcccacagaaatacaaactaccaccagaggatactataaacacgtctatgcaaataaactagaaaatctagaagaaatggataaattcctggacacctacaccctcccaagtctaaaccaggaagaagtcgaatccctgaatagaccaataaaaagttctgagatggaggcagtaattaacagcctaccaccaaaaaaaaatcctggaccagacagattcacagctgatttttatgagggatacaaagaggagctggtaccattccttctgaaactattccaaacaatagagaaagagagaatcctttctaactcattttatgaggccagcatcatcctgataccaaaagctggcagagacacacacaaaaaagaaaatttcaggtcaatatccctgatgaacatcgatgcaaaaatcctcaataaaatactggcaaaccaaatccagcagcacatcaaaaagcttacgcaccatgatcaagttggcttcatccctgggatgcaaggctggttcagcatactcaaatcaataaacgtaattgatcacagaaacagaaccaatgacaaaaaccacatgattatctaaatagatgcagaaaaggccttcgacaaaattcaacaacgcttcatggtgaaagctctcaataaactaggtattgatggaacagatctcaaaataataagacctatttatgacaaacccacagccaatatcatactgaatgtgcaaaaactggaagcattccttttgaaaactggcacaagacaaggatgtcctctctcaccactcctattcaacacagtattggaagttttggctagggcaatcaggcaagagaaagaaataaaatgtattcaaataggaagagaggaagtcaaattgtctctgtttgcagatgacatgattgtatatttagaaaaccccaacatctcagcccaaaatctccttaatctgataagcaacttcagcaaagtctcaggatacaaaatcaatgtaccaaaattacaagcattcctatacaccaataacagacaaatagccaaatcatgagtgtactcccattcagaattgctacaaaggcaataaaatacctaggaatgcaactcacaagggatgtgaaggacctcttcaaggagaactacaaaccactgctcaaggaaataaaagaggacgcaaataaatggaaaaacgttctatgcttatggataggaagaatcaataacatgaaaatggccatagtgcccaaagtaatttatagattcaatgctttccccaacaagctaccattgactttcttcacagaattagaaaaaaaactttgaatttcatatggaaccaaaaacaaaagtccacatagccaagaaaatcctaactaaaaagaacaaagctgggggcatcatgctacctgacttcaaactatactacacggtgacagtaagcaaaacagcatggtactggtcccgtaacagatatacagaccaatagaacagaacagaggcctcagaaataacaccacacatatacaaccatctgatctttgacaaacctgacaaaaacaagcaatggggaaagaatttcctatttaataaatggtgttgaaaaaactggctagccatatgtaagaaactgaatctggactttccttacaccctatacaaaaattaactcaagatggattaaaggcttaaatgtaaaccctaaaaccataaaaaccctagaggaaaacctaggcaataccattcaggacataggtgtagacagagacttcatgactaaaacaccaaaagcaaaggcaacaaaagccaaaattgacaaatggaatctaattaaactaaagagtttctgcacagcaaaataaactattttcagagttaacaggcaacctacggaaagggagaaaaaatttgcaatctatccatctgacaaagggctaatatccagaatctacaaagaacttaaacaaatttacaagaaaaaaactcagtggccaaaggctatgaacacacacttttcaaaagaagacatttatgcggccaagaaacataaaaagcccgtcatcactagtaattagagaaatacaaatcaaagtcacaatgagataccatctcctgccagttagtatggcgcacattaaaaagtcaggaaacaacccatgctgtaaaggatgtgaagaaatagaaacgctatacactgtttttgggagtgtaaattagttcaaccattgtggaagacagtgtggcaattcctcaaggatctaaaactagaaatcccatttgacctagtaatctcattactgggtatatagccaaaggattataaatcattctaccataaagacacgtgcacatttatgtatattgtggcactgttcacaatagcaaagacttggaacaaatccaaatgcccatcaatgatatactggataaagaaaatgtggcacatgtacaccatggaatactatgtagccataaaaaggataagtttatgtcttttgcaggtacatggatgaagctggaaaccatcattctcagcaaactaacacaagaacagaaaatcaaacaccgcatgttctcactcataagtgggagttgaacaatgagaacacatggaaacaggaaggggaacatgacacactggggactgtcgggagctgaggggctaggggagggacagcattaggataaatacctgattagatgatgagttgatgggtgcagaaaaccaccatggcacctatatgtcttttgtaacaaaactgaacgttctgcacatgtaccccagaacttaaaatatattaataaaaaatatatttatgtttctacatattgacaaatatgaataaattgttattaaaaattgtgcacaagattcttcctaaatatgttttcactgttcttgagaaaatgcctaggtataggatttctaagattttatgaagtcaaataaaaactctaggaaatcaccaaactgttttccaaattgtttttaccactttacatttccaccagcagtgttccgcatcttccagttgttccacatcttcactagaacttagtattgtaggggtttttttgttccctttaactttctaaagctgtgtaatggtaccacattaatctcattgtgattgtagcttgcatttttcaaatgacattgagtatcatttaatgtgcttattatatattgtcaaatgtcagttcaatattttgccaggttttaattggattatttttctcattattgagttttaaaagttatttacatattcctaataggcatcttgtattaagtatgcatttttcaaatattttctgggtcatttctttctcaacaatatcttttaaagaatgaatgttttaaattttgataaagatccatttatcaatattttttatgaattttaattttggtgtcatatttaagaattatttgcctaacataagatcacacaaatatttctgagtattttgtttctcgaagttatttaatgacatggtttggctctgcgtccccacccaaatctcatcttgtggctcgcataattcccacatgttgtgggagggacctggtgggagatgattgaatcctgggggctcgtctttccagtactgttctcctgaccatgaatgagctcaaaagatctgatggttttaaaaacaggagtttctctgcacaagctctctcttttcttgatgccatccatgtaagatgtgatttgatcctccttgccttctgccatgattgcgatgcctccccaaccatttggaattgtaagtccaataaacttctttcttatgcaaattgcccagtctctgacatgtctatcagcagtgtgaaaatgggctaatacatataattttctgttttatatttagatgtacaatttattctgatttaaatttttgtgtgttatagatcaagtccttttctttttgtctttcattcattactatttttatttttgcatatagatgaacatttctttcaccacaacttattggtgactgttctttagccactgatttgcctttgtgtctttttcaaattgatcgtacatgggtgagtgtattcctgatacattcatatttgtgtctgtccttttgctaaaacaatgctgtcttaattattaatattattcatattatgcctctttaataaatcacttaatgtgaatcttccaacttagttcttttaaaaaattgtttattccactttacttaaatgtgtatgtatccatcaacagagctttaaagtacgtcgtgtaaaatctgatacaattgaaagaagaaaccaacaaatgcacaattattcttaggaacctcagcactctcttttcagtaatttatagaacaaacaaatgaaatcagcaaagatatagaagacttaaaaaatactgtcaagtaacttgacctaattgacatttagagaacattccatcaaacaaaagcaatatctatctatctatctatctatcatctatctatctatctatcgtctatctatctatctatacacttttcaattgcatatggaacgttcaccaaatagaccacagtctgggacaagggtgttcaactataaaaaaaaatcattcaatgtgatccacataaaagcagactaagcaaggaaaacaacacataatcatatcaatatacaaagaaatgcatttgacaaactcaaaattcatgtatgattaaaaaaaattctccacaaacctagaaggtgatttccttaatatgaagaagaatatctatttaaaaatttacagctaacattatacctaatggagaactgctgaatgactacctctattggaaagactaagcaatgaaaatacacttttagtactcctattcaatattacagtgcttccagtcctagcaagtgcaagtaagtgcaataaggaaagaaaaaagattttaaaatgcatgcaaattgaaaaggaagaagtaaaaaaaaaatccccagtgatagactagatgatcatctatgaagaaaatctcaaaaaaatctacaaaaaagctctcagagttagtaagtgagtttagtacgtttgtggcataaaagtttgacataggaaatcaatcattattttatatattaataattaacaattgaaaaccaaaatactaatactaattatcatatttctttaaaaatgatatatgtaagtatgaatataacaaaacatatttaagatatatatatggtgatatggtttggctctgtgtccccacccaaatcttatgtggaattgtaatcccaaagtgtggagggagggaccaggtgagaggtgatttgatcatgggggcaattacttcagctgttctcatgataataagtgagatcttactagagctgatggttttaagtgtggcacttccttgctcttttcctctctctcctgctgccttgtaaagaaggtgtttgcttctccttcacattctgccatggttgtaagtttccagaggtttttccagtcatgcagaactgagagtcaattaaacttcttttatttataaattacccagtctcagatagtctcttcatagcagtgtgaaaatgaactaatacatatggtaaacattacaaaatgttaacaaaaaattaaggaagacctaaataaatggagagacataccacaggtatgaactggaaggctcattatagttaaaaagcaattttctataaattgatttctagatttaaggcagtttaaattaaaatattctcaggattctttttagatatcgacaattttattatgaaatgtgtacggaaagttaaaagcagtagaataggcaaaccaatttggataaagaacaaggttgaacgccttacactacttgacattacaaaatacaaaatttagcccaggaaaagttggacatgtagaccaatggaacaaagtacagttttacaaaatagcctgtacaaatatggccaacagatttttgaaaaaggtgtaaaggtaattaaataaaaatctttttgagaaatgattgtagaacaattgaatattcatgtgcaaaactgtaaatgttgatctacagctccttcttctccaaaaacatgttttaaatggatcatagatctaaatgcaaaacataaaactgaaaaaaaaatcttagaagaaaacatagaaggaactccttgatgagaggaggcagaataagatagcagaataagaggctccatcaatcatcctcccttcaaggacatcaagttaacaactatttacacagaaaaaaaaaaaacacctttatgagagccaaaagtcagatatgcacccatagtacctggttttaacttcatattgctgaaagaggcactgaagagatagaaaaaactgtcctgaatgccagcattactcacccaatgcccttcctctggaagtggtggcatggtgtgtagagcacccctggacaccagggaagggagaaaacaacaattgtgaggcattaaaaatgctattctgttagagctgaaagaaaaactggactaaactcagctgacacctgcacatggagggaccatttaaaccactcctagccagaggggaatcacaaattccagtggtccaaacttgagttcccacaaacctcaccacagagggctacagtgctctgtttctccatgtaaacctgaaaggcagtctaggccataggactgcaactattaggtgagtcctagtgctgaacggggcccagggacaatggactgaaggagcatgtgccatactgatacatcaagtggggtagtcaagagagttctggcatcacccttcccctaatcccaggctgcacagctcatggcttcaagacagaccctttccttttgcttgatgagaggaaagagtggggaggtctttgtcttgcatcttggatacagtctcagccacagcagaagggatgaagcacctgtttcaggccatagcatccaggtgacatttttagacacactcgggacaaaaagggaacccactgccatgaaaggaaggatgcagtcctggcagcattaattacctgctaacttaagagcccttgggccctgaataaccagcagtatacccaagtactatgttgagggacctgtgtgactcagcacattaccagctatggtggccgtggggcaaaactcctgcttaacaaaagcagagggaaaagtaaaggggactttgtcttgcaccttaggtaccagcatggccacgggggagacaagccccgagtaggcttttgaagtccctgatgacagaacttgacttctgcatggcatttctggacctgccctaagccagcgaggagaccactgctatcaagggtgagtcccataccaggcagaattcaccattcaccacaagctaacttaagaggaaatatcaatggtagtctgtcagtactccttgtggcttgcggtggaggtagctacagggtgaggcaactctgcctttggaatggagaggaaaaagtgggaaggattacttcttacggttttagtgccagctcagccatagtacaacagaacaccaggtagacttattaggtttttgactcgtccctgactcctggatgacacctctggacccacctcaggcctgggaaggcactgccctgaaggaaagaacacaggcctggctggctttgccagtagctgactgtagagccccaggcccttgagcaaatataggcagtagcaaaggagaggttacagcaggccttaggtgagacccagtgctgtgttggcttcaggtctgacccagaagagtcatagtggtggtggccacatgggtgcttgtgtcactccacccccagttttaggtgacttagaacagagagagaaaccctgtttgtttgtgagaaagtaaggaagagaacaagagtcttttcctgataatccagagaattctcccggttcttgtccaggaccatcaggtagtacctctacaagtctgcaagaaccacagtgttgctatgtttaaggtgtcccttaaagcagatacagcttacatcacaacacccaagtcctttcaaatatctgaaaagccttcccatgaaggatggctacaaataagcccagacaatgaagacaacaataaatacctaactattcaatgcccagacaccaaagagcatctactagcatcaacaccgtccaagaaaacatgacttaatcaaatgaacaaaataaggcaccagggaccaatcctagagaaacagagatatatgacctttcagacagataattcaaaatagttctgttgagtaaactcaaagaaattcaagatagcacagataaagtattcagaattctctcagaaaaatctaacaaagagattgaaataatttagaataaccacgcagaaattctgaaactgaaaattgcaaatggcatagtgataaatgcatcagagtctgttaatagcaaaattgatgaagcagaagaaagaattagtaagctgaaagacaggctatctgaaaatacacagtcaaaggagacaaaagaaaaagaataaaaaacaatgaagcacaccgacgggatctagataatggcctcaaaagggcaaatctaagagttattggcctcaaagcaggcatagagaaagaaataagggtagaaagcttattcaaaaggataatagcacagaacatctcaaccctagagaaagatatcaatatccaagtacaagaaggctctacaataccaagcagatttagcccaaagaagactaactcaaggcatttaataatcaaactcccaaaagtcaaggataaaaataagaattataaaagcaacaagacaaaggaaacaaataacctacaatagtgctccaataaatctggaagcagacatttcagtggcaaccttacaggccagcatagagtggtataacacatttaagtatgaaaggaaaaatgcttttactctagaacagcagattgagcgaaaatatccttcaaacatgaaggagaaataaaaactttcccagacacacaaaagctgaggaatttcattaacatcagacctgtcctacaaaaaatgctaaaaggagtactgagtacttcaatcagaaagacaaagacattaatgagccataagttatcacctgaaggcacaaaactcactggtaatcataagtacatagaaaaacacataatattataacccagtagcagtggggtgtaaaccactcttatcctaaagtataaaaactaaatggtgaaccaataaaaagaaaataactacaatgactttttaagacagcacaatatagtataaatagaaacaacaaatattaaaaaggagggagatgaagctaaggtgtagagattttggaggttatttttgcttgtttttttgcttgtttatgcaaacagtgttaagtttttatcaggtttaaatgatgtgttataagatagtatttgcaagccttatggtgacctcaaaacaaaaaagcatacaatgcatacacaaaaaataaaaagaaagaaactaaatcatatcaccagagaaaaatcatctttactaaaggaagacaagaaggaaagaaggaagtgatagcaataagaggtagaaaaatcctaggcagacagaggcaggtcctgggtgaaaccccaccttctagccaaagacagtttaaagcctgaaagccagggaccttcttcacaaggtggcaggaaggagaagggcagactgaagggggaagagccccttataaaactatcagatctcatgagaattcactctctatcatgagaagagcctggggaaaaccacccctatgatttaattacctccacctggcctctctcaacatgtgaggattatggagattataattcaagatgagatttggatgggaatgtacgaagcctaaccttatcattctgcccctgtcacacccaaacttcatgtctttttcacatttcaaaaccaactatgcctttctaacagtcccccaaagtcttaattcatcccagcattaaccaaaaagtccaagtccaagtctcttctgagacaaggcaagtcccttctacccatgagcctgtaaaataaaaaacaagttagttacttcctagatacaatgggggtacaggcattgggtaaatacacccattacaagtggaagaaattggccaaaatgcagggactataggctccatgcaagtcccaaatcaagcaggacagtcaaaccttaaagtttcaaaatgatctcatttgaatccatgtctcacattcaggtcacactgatgcaagatgtgtgctcccacagcctttgtcagtgccacacctgtggctttgcagggtacagcaccccttctggctgctttcaattgttggcatttattgtctgcggcttttccagccacacagtgcaagctgccagtggatctaccattctggcctctggaggacagtgacctcttctcataccttcactaggcagtgccctacaagggactgtgtagtggctcagaccccacatttcccttccacaatgcactagcagaagttcttcatgagggctccacccctgctgcaagcttctgcttggacatacaggcatttccatacatcctctgaaatctaggtggaggttcctaaccctcagttcctgacttctgtgtacccacaggctcaacactatgtgtaaaccaccaagacttagagcttgcaccctatgaagcaatggcctgagctctacactggccccttttagccacggctgggatgcaagccaccaaatccgaagactgcacaaagcagcaaggccctgggccaggaccatgaaaccattattttctcctaggcctccgggcctgtgataggaggggctgcagtgaagacctctgatatgccctaaagatatcttccccattgtcttggtgattcacatttggctcctctttgcttatgcaaatttctacagctgacttgaatttctcttcagaaaataggtttttcttttctgttgcatcatcaggctgcaaattttctaaacttttatgctctgcttcccttttaaacattagtttcaattccaaaccatctctttgttaatgcataaaactgaatgctttcaagagcacccaagctcttgaatgctttgctgcttagaaatttcttctgccagattccctaaattatctttcatgttcaaaactccacagatcactagggctgtggaaaaatgctaaagcataacaagagtcacctttattccagtccccaaaaagctcttcatctcctctgaaactaccttagcctggacttcattgtccatatcactatcagcattttggtcaaagccatgccccactaccttggtatcaatttactgtattagtttcttctcacattgctataaagaactgcctggaactgggtaatttataaagaaagaggtttaattgactcacagttcagcatggttggcaaggcctcaggaaacttagaattatggcaggaaggaaggagaagcaaaataccttcttcacaaggtggcaggaaggagaatgaatacaggaggaactaccaaacccttataaaaccatcagatcttgtgagaagtaactcaatatcatgagaacagcatggggaaaaccacccacatggtacaattacccccacctggtctctcccttgaaacacagggattatggggattacaattcaagatgagatttgggtgaggactcaaagcctaaccacatcaactcatatctcttggaatgcacagaagtctaatcaaagttaactaaagacttaaatctaagacctcaaactatgaaactattactagaaaacactgggacaaatctctaggacactggtttgggcaaagatttcttgagcaataccctacaagcacaggcaaccaaagcaaacatggacaaatggaatcatgccaagttaaaaaccttttgcacagcaaaggatacaatcaagaaagtgaaaggacaacccacagaatgcaagaaaatatttgcaaactacccatctgataagaggttaataatcagaatatacaaggagctcaaacaactctatagaaaaaaatatataatgaactgatcaaaacatgagcaaaagatttgaatagacctttatcaaaagaagacatacaaatggtaaactggcatattaaatggtgctcaatattgttgatcatcagagaaatgcaaatcaaaactacaatgagataccatatcacctcagttaaaatggcttatattcaaaacacaggcaataacaaatgctggccaggatgtggaggaaagggcactcttgtatattgttggtagaaatgtaaattattgtggagatgagtttgggggttcctaaataaaactaaaaatggagctactttatgacccagcaatccccactgctgagtatatacccaagagaaaggaaatcagtatatcaaatatatatctgcattcctatgtttgttgcagcactgttcacaacagctaagatttggaagcaacaacagatgaatacataaagaaaatgtggtgcttatacacaatggattactattcagtcattaaaaagaatgagaatctgtcatttggaacaacatggatggaactgcagattattatgttagattaaataagcaaggcatagaagaacaaacattacttgttctcactcatttgtgaaacctaaaaatcaaaacaagtgaactcatggacatagaaattaggagaattgttaccagaggctggaaacagtagtaggggactgggggagaggtggagattgttaatggatactaaaaaacagagttagaaagaatgaataagacctgctgtttgatagcataacagggtgactgtagtcaataataacttaattgtacatttttaaataacttaaagagtgtgactggattgtttataactcaaaggataaaagtttgaggggatggataccccattctccatgatgtacatatttcacactacatgcctgtatcaaacctttccatgtaccccataaatgtatatacctactaagtacccacaaactgtttttcaaaaattttaaaaagaaactccttggataatccatgaaagaaaaagatgataaactggatttgaaccaattaaaataatttgctctgttgtcaaaaagaggatgagaaaacagcccacatgccataagaaaacattttaaaatcatatatcttgtacccaaatgtaagaaatctcaaattttaacaataagtaaataaacacagtaaaaatatgttcaagagatttgaactgacatgatagcaaaggtgctatatgaatgacagtaaggcacatgaaaaggtgatcaacctcattattcattataaaaacgctaattacaacatctaataaaaacatactagaatggctaaaatccaaaaacaaaatgacagtagcaaaggctagtgggaatatgaaacaactggaactgtcatatgtcactggtagaaatataaatggtacagctactctgggacagtttggtgtttttgtacagttaaacatagacttactgtataacccagcaatcccacttatgttcacacaaaacctgctgcttacaatcaccccaaactggaaaccacccaaatgtttctctaagaattactggattaacaaattgcattatatccccatacaatgaaacattactgagcaagaaaaaggaacactctatttttacacaaaacaatttggatgagtcccaaatgctaagtgaaagaaggccatttctaaagtaacatactgtatgtttctacttacatgacattctgaaaaggtaaagctattaggaagagaaaacagattggttgttgccagtggttaggtttggtgggactgtctacctgcaaatggtagtatccaaggctccatagggtgttgggattgttctctatcttgttaggaaggctggttacaagaatatatgcttgcgttaaaactcgtaactctggatgctatcagaaaataaattttactttatgtaagttcaaatataataaatgatagcaatttgtgatattaaggtcatttaatttaaaaaataatatctaatcaacccaatattaagaaagtttaacattatgatcgcaaaattctaagtaatttaattgtactcaatgtgaattactttctcaaaggagcatgtgattgtaaaacctacctgtaagtttgcttgtaagatatcttatccatctctaatcagatgtcatggaagtggatgaatgtccctatcctttaaatgttctgctttaggaacagaaaaccaaataccacgtgctctcacttatcagtgggaactgaatgatgtgaacacatggacacgtggtgaggagaaacacacactgggacctctcagagggtggggctgcgggaggaagagcgtcaggaagaatagctaatgagtgctgggcttaacacctggatgatggggtgatctgtgcggcaaaccaccatggcacttgtttacctatgtgacaaacctgcacatcctgtacatgtacccctgaacttaaaataagaattggaaatttaaaaaaacaaaaagccaaaaatttctgctttaattaaatatcattatctttttataatgcaaagaaaaatgtgtcttaaattgtatttaagattacattgattttattcgacaccatcattcagtttacctgaaattcttatcctgaaaatatctgacataggtgactctacatataacaaaagaaaacaaatatcagtaactttacagattgtgccaaacttcttcctcaacgtaatggactgtgttatcagccattcaaagcatctacatctaaacgaagacatctagatgagtaacttctatgcatagcttcagttattcaattttgctcaaattacagtggactactagtgaattgtcactatagatattcataggcttcatataaaatattggccatgttcctatatgattctggttgctccagaggtcttggattcataattacctgagcgtttctaacatgtattaacatgaagcatcaattgtttctggtaaatgaggaataagtggtttttgttcagaattgctctctgtagattctctgctagtattataatcctctttgattgaggtaaaaataacctggatgactaaaggtaaatttttccacaaaggagaattaatgcactgtctgttttctgtagaattatgacagattttatgcctttgttaaatcctaagattagttggtataactactttcaatgctctggcctattttctttgttgctaaaatgaaaatagatcagaaacaccttttgaggcctctggatttataatttaagaattaactctgagaaagtagtaggtgaataaatagagttataatctaagacaacgttacattccttgtgtgagtctcacatctaagacccggcagtactttcttcctctgtgcattctcacgaatacccacacactgtaagcatagtttctaagattccataattatgaatcctaacaataagaatgactcagaatgcagaatattacaatgcagactctgtcctgtcaggtaaagtaaggaaaggtaaatactgcttaccgatacacattattaaatggtctgttctaatttctaattgtaacttcttggtttcaatattagacatacatagaaagttctgcctaagtaacttgaggctgattccctgtggcacaggtccttactaatagatggtggttttagaatttgcattaagtctttctatctagttcatttcaacaaatatttaccgaatatccactctagtcgaggcactgtgctaccatatgggaacataaagatgactaggacaatccctatcctgcaggagtgtacaattacaaagcagagatgtgttgattgttatgattaatataaagtatagcagggttccaaatgcatgaagctagactgaagcatggagaatatttaaaggagaaaaaccctgagtctacttggggagattaatcaagatttcaaggaagaggtaacattggaaagggtccactgagagggagtcagactttggtgggcacaaacccaaaatgaaggagatgggaacagtaagtgcttttgtttactgcatgcggattgatggtgagaagttaaccagtaaatcggagagcccagaccttaaatatctagtcaagtttgtgttccattaagacaataagtttgctgactaaagatttttgaaagaattagatgacattttcatgaaaaaatacactcatatggacatcagcatgcacatacatatgtatacatatttatacagagcatacatatatatttatatacatatagagtacatttcatttaaatgaaacgaaactacttggactgtggaggataaatttagagaaatctacacttggaatcacctgttacaatataaatataaaactttatggcatagatagtcatcagtgttatactcagaacattcaagtaaatatatgataattgtataatatcagggttatatgcttttatagtataatgcatataaatttatagtatgtagtatactagtaggctcaaaatatgactagtactggtgccattatttttgaaaattagctaaggcactaaaaaagataattcatgtgaactagactgataagctgaaaacattgctacttgttatttttatgtcaaatgtaatttgttttagaataaacattataattggctattcaatgcccacacacttagtataactttttaggtagaatcagtgattttatggtaacgtctaaccttgtggggaaaaatatttctctaaacttcagtttactgaaacttaaatttcacacagagtcattgactaaaaaagaaagtcaccaggaccttctcatccatctcataaattgctaatgcccacttctaatggtgcatttgcaattggtttggtctatgaatgacacacccataatcatataacttcctaataacattttgtggtttatactcctctaataattctctgtttaacaatggtcataatgattttcatacaatacagatacttaaataatattttgcatttttccagattatattttggcataagttaaacattatgttcattgtttatcttcaattaaaataacagacaaatctactaaagtgaaagacatggcaggaaggtaaagactctaaaagcacatgtttttaattgtgagaaataattttgtccatttctagaaaaaagataggaaaggtgattcttaagtatttaatgtacagataaatgattcattaataatttttacacaattatttaatttgaatggataaatattattaagaattgtcataagtatatatataagacatagtcttacatgctgtattagtccatttgtacactgcctaaagaactacctgagactgggtaatttatgaagaaaagagatttaattgactcatagttccacagccttaacaggaagcatgactggaaggccttaagaaacttacaatcatggtggaaggtgagagggaaggaaggaccttcttcacatggtgccaggagagagaggcagtgaaggggggaattatcacacacttttaaaccgtcatatctcatgagagctcactcactattatgagaacagcaagggggaaatttccccccatgatccaatctcctcccaccagtctcctcctccaattcaacatgagatttgggtgggggcacaaatccaaatagattattgtaagtataatgaaatataagtgccatttatttatttaaaaaccattttttgagaacatactatgtactagacatggtactgtaactcttgttctgaggattgtatgaaaattatcatgttaaaattcatatgacaaaagaatgggtctacctcaagaagggtatgggaagctataaaaagaatggatatttgatctggaatttaaagatcaggtagaagaagcttgtcttaatggaaatagagataagacatgagagagtgaaaaaagaaaataagcaaaaatagaagggagcttaaatgctatcccatttgttgtgggttgaattgtgttctcccccaaaatatgtcgaagtcttaaccccagtacctgtgaatgggaccttattgggcaataggatctttgaagatataattctgatgtaacttagtagatggagtcatgctggaggcccttaattcaatacacctcatgtgctaaaaaaaagagaagggacgagaagagacatatacagaaagaaaataacaccatggcagaatacagacacacacagagaaggaagacagccgtgtgactttggtggaagagatgtgagtgatggcaactgcaagccaaggaacacacaagattgttcaaaaccctcagaagctgggagagaggcatgaaacacattttccttcagaatccccaagttgcaaccaaacctgccgaaacctggatttcagacttttagcttctaaactgtgagagaataaatttctactgtttaaaccacccagtttgtgggaacttactacagcagtcccaagaaacttgcatactatgctgaataaatgaggtagagttgtcaaaaggtggaacaattagttataaaaacatatggagagaaatgagaaggaaagaaaaagtctaataaaactaggcattttgtgaataagctaaggagtcaaactcttagcatataataatatagagtttgtcttttaattcaaggcagttacattcttctatttttttttttattaaagagagcatgagtttcagagaagatgataattttgaaaggctaaaagctacagctatataggccagagaaaagacaatttcaattttctaatgagggataatgatagtttatgctatgtattgttacacatgtaatgccctctagagatgaacatgctacattggacccagcctaataaacgacctttgatgtcgttttcctatcaatggtgaagggtttcgccaatctatccagagtttcccttcttgtttctctgggggttaaggccctcattagaaagttagacagagagggtaataccttggtaatggcatgggcaatgtctttgatgaatacactcttaagagcaagataatttaagtgcacattacagaatattatggcaaacaataaagcttgcatagattgaaaaacagacctttccctcactgttattaactgggaaaactagctttgaattgtaattaattttggggttggatcagttataaaatgcatatcttataaactaaaggtttattttttcggacaagatacaacttccagtaacaggtgaatttgaataagtattaactaattttaaatagttatccaaaataacattatctagttagaatcagagggacacacacaggttgggaaatattttgcatttcttggtgcaattctatatttaatgatttttttctatgatctataataataagaacaattattgacattgtatttggtaaaaaatgcttgatttggattcgaagtttcattcttacaaaactgtatgttttggtgtcaaaatgataactcaatatacatcatattcttatatcactggaccactgtaaatgtataaaaagtctaggatatagttttctttaattttacagtttaaaaaataaatttctgagaaagtcatcacaattattgcaaataattgtatgattatgaaaaaaatggcagtagtcacaatgctacttgtaaacagaaagatacttggtcatgtgaaagatacttgtagtccactaggcacatataggccatacttcttcaatctaaaagacagaagaggcatctgagtaacagacatgtttcctttactcacctagcttcctttttctatcctttattgaattataataatagaataggtcttattatcaattaagtgatctttcttgttctcacaatgagagcagctgcatcaagtaagttttcgccttactaaaaactttcagatgtcttttggttttattattcaatttttgagatgtataattaaatccctgggaatgagtggatataatttagaaggcaattcagctctgtgaacttatacagatgtcactaaaatcatgtttgatggataatttcagaaacaatgaaagcatcattaactagagtaacttggaaaagcacaagtaaaagacactgttattttgacaatattgagttaaatagaggccacaggaaaaaaaaaaaaaaaaaacctgcacatcaaagttaaatgatcagcattcaatgtaagacattcttggagaactggaatgtttgctttggttttgttgaagtgattaacatgaatatgtcagctgcgtaattcagtgaacaaaattcatttcactgtaggaagtccatgtgggttaaaggaaaacaaaatctctttgtatgtccaaatggttttaaaaaggatctagggaacagttagtatggttcttactaattgttttctttctttaggtggaataaataattctaataaataaagggaataatcataagaatattctgaaaggaactaacagaaagctcagtgcaaaatgaaaaactataagcttacaataaactatgttttgtatatagatttataggtatataaaaggttagataaatagaacagcaatagagaacagagatagaaataaagattgattctaggtctataccatgtctttatttaatttaatataaaagaaaatcatcgatcaaagatgcaagaaattttttttaagaatccaaatgttgttagaattgactgtaataaaaatagtttgccatagggcttttcatggtacattaaaattaagaaaaatattttcccatttactagcaggtcaagttgcttcttttcagtgatcataatcaattatccaggaaaagggacagaagaaatcaggaaaaaggagaatagactctttatgcataggtaggttcagaattaacaaagttttgtggtggtggttctttgctttgacacagattcaatgtaataaaatttgtaccacctttaggcaaaattgagaccaatagaagaaaaatgtaacatagagtcttgaagttgtgtcaatagaagaatttaaaaacatatttgcttttaaaaattgttttatggccatataatttgcattcaataaagtgcacacatcctaaatgttcattttgatgagttatgataattttatacactcctgtaacaaacaccctaagtaagatatagaacatttgtatcaccctagaattacattatatgcctttctattcaatttccacctagaagtgggagctactttctgatttccaccaacacatatcagtttgttttgcatagtcctggattcttataaattgaatcatgtagtgtgtaatcttttgtgtgtctgacttttttcactcaacataatatcgttaagatccatgcatatggttgcatgtatcattaatttgttagtttattgctaaatagtacaccattataggaaaatatcaaaatgtattaatccattctcttgttgatagatattcgagttgtttctattttatctactgtaattaaggctgttataagcatttttatataacatgtttatggacgtatgttttatttttatttggataaagactctagaacacaattgagtgatcataacattagattgtatatatttaagtttaactgtataagaaattgccaaagtgttttccaatagtgttgtagtattttttgtcaccaccagcaatttttgagaatgcaagttgttctgtatgttaggcaacataatggcccccagagaagtcctaatcccaaaaacctatgaatttgttactttctatggcaaaaggagctttgaagatgggattagtttgaggatcttgagatgggaaagttattctggattatctgctgaatcgagtataatcacagggtatttgtaagatgaagacaagagagtcagcgtcaaagagatataataatggtggcagacacagaggggaaggagagaaagagaaagcagaagatgctctgctgctggctttgaaaatggtggaagaggccatgaactaaggagtgaatgtggcctccagaaggtagaaaaggcatgggaataggttatccctttagagccttcagaagaagcccagacctcccaacatcttgatttttaggacttttgaccacataacataatatttaaaagttgtgttgttttaagccactaagtttgtggaaatgtgtattagcagtaacagaaaactaatatgcatccttgccaacatttgctgtcgccaatctttttagttttagtcattctagtgggtgtgaaatggtttagcattatcattttaatttgcatttccttgatgacccatgatgttgagcaaattttcatactctatcaggccatttgtgtatcttttcctgtgaagaatttcttttcaaggctttgaccatcattctactgaattattgtttcttctgttgttgattatcaggagctttaatatatagttgacacttgaacaacatggatctgaactacacaagtccacttattggtggattttcttcagcctctgccacccttgagacaacaagaccaatacctcctctttttccttctcctcagcctactcaacttgaagatggtgagaatgaagacctttatgatcatccacttctacttgttgaatagtaaatatattttttccttatggttttcttaataacactttcttttctcttgattactttattgccagaatacagtacatagtacatataataagcaaagtatgtattagtttactgtttaagtgataggtaaggcttccactcaacagcaggcaacagccaggtgttgtgacacatgcctgtaatcctagcattttgggaggccgaggtggaggatcgcttgagcccaggagttcaagaccagcctaagtaacatagtgagacccccatctccacaaaaaattaaaatacctaatcatggtggtgcatgcctgcaatcccagctactcaggaacctacaataggagccaaaaaggtggaggttacaatgagccattattgcactactgcactgcactcctgcctgggagacagagtgagaccttgtctcaaaacactacaacaaacaacaacaacagcaacaaaaatcagtaggtattaatagttaggttttttgggagtcagaagttatacacagattttgactgtgcaggggatcagcgctcctaacgcctgcattcttcaagggttacctgtattcttgatacaagttctccttcagatttaagtattatagatatttttccagtctatagcttacctattcattttcttaataatgtcttttgattgatttttaatttttaactttggtgaattccagttgtatactttttttatgattagcatttttgtgtcctatgaaactgttgccttcctcaatgtcactaaattctcttaggttttcttctagcaagtttatgtttcaaattttcacccttaggtctataattcgtcccaaatttatttttgtctgtaaagcaatgtcacgattcattttttttctcaatataattacccagttgtttcaaaactggttattaaagtttttctcttaatcattgaattttcttggcaccaaattattaactcttgacaaaaataattgacccttaagtaagcagacagacaagcagtgcttctattttatagcaatgtaaataatacacaacttacacaaagactttttagaagctaactaacagtggtcctatctaagtacgtacaccagattttttataaccacttttaaaataaaagtatttagattttaacacatagattaggacagagaaagcatatggtggaataaactgtatctttttggccagatggtgctatttctaggtcatcttgataaagagaggaggcaaacatgaaaacttaatgaaaaactatttatgatgctggagagaacatcttggctttgagtcacttttaaatcatagaagaggattattccataaaattatttataatgcctaaaattattctttgcccaaatcataaattttcagcattaccaagaagccatttagtatgtatagggtgtttcagcaagtgcagagatgcccaggtggttgggattcaatacaacgagctgtcacgctgcacattcttggagtacaaccttaatgggcattttcccacctgtgcaattcctctgttttcaccccactccattcatatttcacaaactactctaattatagtatttattattgacctcaggaaaaagaagtttgaaagggtggaaaaaacatgcattttgtctccatggatagtaaatcactgagctattgttccttgggaatcccaattcatgagaaattacatagacttttgccctaacactaatcagctgcctgatctgtaaatatttcagatccttgcctgtatctatttctccttgcagaaaactgtaatttatctagatttttctaataattcactgacattttactgctatccaatgagtaaatcattgttgcttttggtatcttatgattttgttcttttgtgtcaaagtttagctagtttcatctatcaggttggaataaaaaatgcaaattatgactataccacttatatagttacatgatctactgaccaaagttaatcatcactttaatcttggtaactcattcagagccctaattgtaatagcctttgcctgagttacctagagagtggtctcaataatccccttttatttttcatgtagagaaaagggcacacaaaatgatattatctcgatcacccagcacatgtattaaactataacagactttttaaatcatgtgtgatcttttattttttgactgaaagggactaagtttgctgcccagagaagtctttagggagcaaggaaaggtaagcaaataaacttatctggagtcaaaggtctcaaggaaaatcttgctttctataaaaggcagacaacgtcaagactcatagattttcccagggctaaaaatcagagccaattgcctcccatcttgaaaagactcattcatcatgctggttgaagtatcacagatcttgtcaaaatattcatgactcacatacgacccatccaaaagacaaaagccaacaaaatattttaccaaattctaaaatagtgtttgttttattattctttgttattcttcaacaattattgttacctttactatatgaaatataatagcaattccttgtcttcatggtctttctgttacagacatgttttacactgattataccactttagtgaaattcatcatacatattcctgatccaaattccttttttattaaccatatatgagagaaagtggatattaaaataattttgatggtaaaataagcgaaaaaataaagcaagcatggttaaaatgattaaattatggaaaagtgacccatgtgtttcagataaactgacgcttgagggtttttgttgttattgtggtttaaattttattttattttaattttaagttccaggatacaagtgcaggatgtgcaggtttcttacataggtaaagatgtgccgaaatggtggtttgctgcacctctcaacctatcacctaggtattaagccctacatgcgttagctccctcccactgcccctgcagcagatcccagtgtttgttgttccctccctgtgtccatgtgttctcattgtccagctcccacttgtaaataagaacctacggtgtttggttttctgttcctgttttagtttgttgaggataatgacttccatgaagcttgagttttcattctacaatttactgaatgacatttgagcagctagctgactttttaatgccttgattttaataattcaatgagttattgggtgagataatttagaacagcatacatgatatcgttattattagtcaataaaatgctatttatcttatttattactcataacaaaaatatgtatatgacccttcgctatgtttgaatatgtgatatattgaattgaattcactgtgaggcttcagtaggtacctataatattcaaatatgttacctgaaagctgtgaaaaatatatttttaaaaattagatttacatgcagtcaagttttcttttgatgacacactctcttgatatatactaagttttatacttggaatctttcacttttatccttactcagaaacgtgaatattaagaatcagtagagccagctcttctacatgttccctgccaattgctatcttgcctacttttaaaacacctctaacttgagaaaatgaaaacccacaaactaacaattgttccagggaagtccatggcatcacttggaacttttcatcattagtcccagttacactcttttgtgttgtatacaacattggcatatactctagtcatctgtatgccaagttaaatgagacttcattcagcaaccagtaatatgtcatgcatcagaagtctctctcatcatattgcttatcaccatcaaatagtttccattttgtctttattccttaaaaattgtcatgcttaaaattggtgcaaataatgtagatacttgtgattctattatatctacatatatttttctattttgcaagagaagtgaattttaataaattagttctcttagattataatgctacagaaaaactgaatgacctgactcgttggtgatttgattgggactggatttgtgttcctgcccaaatctcgtgttgaaatgtaatccccaatgctggagatgggaactgatgtgaggtgattggatcatgggagtggtttctaatagtttaacaccatccccgaagtgctgtttcgtgatagagttctctgaagatctggttgtttaaaaatatgtgtacctcccatctgtctcttcctcctgctctggccaggtaagatttgcctgctttctcttcaccttcaccttccactgaagagagaggttaaagattaacccccccactctaatcacatgtactgtctataaatctcaatctatcaagaccctttcacgtggaccccttggagttgtaagcccttaaaagggtctggagctctttctttggagagcgtcattcttgagatgcaagtctgctgacgctcccagccaaataaagcctcttccttctttaacatggcatctgaggggttttgtctgtggctcatcctgctgcatttcttggttccctgaccaggaagtgaggtgattaacggacagttgaggcagccccttaggtgacttacacctgccctgcagagcatccctgcagtgaactccagccagcttgagcgatggggatcctgagaccgctcctgggtaggtgtttgtcctggtagaactcctcgtcagagtggtgcatggcaggcccccgcagatgatcaatgcaatgtctgaacactgggaaggaaccattgcttggagtccagacatctggaatacagaaggaccggtcctgggaacttgcccactgcatttgagtggaagcgtggcctgatcacccactgtgtgcccttatgggcactttggtctcagtattgattttgatttggcttgacctgtttgcaaaaaggaaagtgaaagtgagtgagtgcttgagttttagatgtgcgaggtgagcgagtgacctctttaccctttccttcttgtggtgtgagtgttgttttgtctcgggaggaaaatgggtgttatgcaaagtaagcccactctgctaggaactatgttgaaaaatttcaaggaaggatttaatggagactatggagttactatacaccaggaaaacttaggactttgtgtgaaatagactggccagcattggaagtgggttgggcatcagaaggaaacctagatgggtcccttgtttttaaatgtatggcacaaagtaactggtaagccaagacacccagaccagtttccgtaaatagacacttggttacagctggttttagagccaccacagtggttaagaggacaggcagcagtagtactagtggcaaagggacagacagccaaggaagaatcctgctccaccaacctaagggagtcagctcctaaagtcctgtctgatccaacaccagaggattcatggcaagaaacagcaccagtggccccctttccaccaagaagaaaggtctcccactccgataccccatcctataccaaaaagccacaagctctgatggatttgctccaaactgttatccagacccacaaaccccacctgggctgattgccactagttgctcatatgcctctttaacacagatgaaaggaggagagtgctccaagcagcaacgaagtggctttagaacatgttccagctgattaccaaaacccccaagagtatatgaggatccaattaccaggaacagatgccgagtgggacccaaatgaaagacagggtatgcaaaggctaaaccggtacaggaaagcccttctggaagggttaaagaagggagctcagaaggtcacaaatgttaacaaagtctctgaggccattcaaggaaaagatgagagcccggcacaattctacaagagactacgtgaggcctatcgtatgtataccccctttgatcccagtagccttgaaaatcagcacatgattaacatggctttagttagtcaaagtgcagaagacattaaagaaaatttcaaaaacaggctgggttcacggtcatgaatacttcacagttactggagatagccaagcaggtgtttgtgaatagagacacggtaagctacagagagaactgcagagagagtgaacgccaagcccggcgaaacgccgacctgctagccacagctataagaggggcccccccaaagagaccagagaaggggggccccaggaaaaatacccagtctgtccatccacgcttgcagcgtaatcagtgtgcttactgtaaggaaataggacgttggaaggacaagtgcccacagttgaaagggaaacaaggtgactctgagcagaaggcctcagacaaggatgaaggggccttgttcaatcgggcagaagggttactggactgagggggaccaggctcatgtgcccccaaagagcccattgtcaggatgacagtcgggtacgaggacatttagtttcttgtcaatattggtgctgaacattcagtagtaaccaccccagtcgcccccttatccaaaaagactattgacataatcggagccacaggggtttcggcaaagcaaacgttctgtttcccccagacctgcactgtgtggggcatgaagtgattcatcagttcctgtacatggctgactgccccttgcctttgctaggaacggacctacttagcaagctgagagccaccatcacttttacaaagcacggctctttaccgctaaagctacctggaacgggagtcataatggcccttatggttccctgggaggaggaatggagactcttcttaactgagccaggccaagagataggagcaactctggctaagtgttggccaaaggtgtgggtggaagacaacgctctagggttggcaatcaaccaggcccccgtactcatagaagttaagcctggggcccagccagtcagacaaaaacagtacctggtccccagagaagctcttgaaggtatctggatccatctcgagtgcctgagggcctttggaattgtagtcccttgtcagtctccatggaacaatcccctcctgcctgttcccaagccaggggccatggactgcaggctggcacaggatttgcgcttggtcaaccaagctacagtgactttgcacccagtggtacctaacctgtacacattgttggggttgctgccagctgaggacagctggttcacttgcctggacctaaaggacattttctttagcatcaggctagctcctgagagccagaaactgtttgcctttcagtgggaggatccggagtcaggtgtcaccactcagtaccttggacccagcttccccaagggttcaagaactcccccaccatctttgggggggtgctggcttgagacctccagaagtttcccaccagagacctaggctgcttgctgctcgagtacatcgatgacctcctgttgggacaccccacggcagtcgggtgtgccaagggaacggataccctactccagcacctggaggactgtgggtataaggtgcccaagaagaaagctcagatctgcagacagcaggtaagttacctgggatttactatctgatagggggagcacagcctgggatcagaaagaaagcaggtcatttgcaacctaccggagcccgagaccagaaggcaggtgagagaattcttaggagccatggggttctgcaggttatggatcccaaactttgcagtactggccaagcccctgtacagagtcacaaaggggagcgacaaggaacctttcaaatgggggtcccaaaagcaatgagcttttcatgagttaaaagagaaactcatgtcagcccccgccctggggctgcctgacctgacaaagccatttacactatatgtgtcagagagagagaagacggtggttggagttttgacccagatcatgtggctctggccaatgctggtggcctacatctctaaacaactagatggggtttctaaaggttggcccccatgtttgagggccttggctgcaactgccaatggacggatccagttatcagataaaaaaatagccatgccacaactgctaggagccacagtcgtactggctgttcttgaggccccacatgctgtggtgactttaatgaataccaaaggacatcattggctaacaaatgctagactaactaggtaccaaagcttactctatgaaaatccccacataaccattgacgtttgcaacaccttgaaccccaccaccttactcctggtatcagagagcccagttgaacctaactgtgtagagttgttggactcagtttattctagcaggcccgacctccaagaccattcttggaaatcagtagactgggagctgtatatgaacgggagcagcttcgtcaacccacagggagagagatgtgcaggatatgcagtggtaatgctgggcactgtcattgaagccaaatcattgcccagggtacttcagcccagaaggccaaactcattgctttaatttgggccatagagctaagtgaagataagactgtaaatatttatactgactcttggtatgccttcttaaccctgcaagtgcatggggcattgtataaagaaaaaggcctgttgaactctgggggaaaagacacaaagtatcagcaagagattctgcaattattagaggcagtgtgaaagccccaaaaggtggcagtcatgtactgcagaggacaccaacaatctttcaccttgattgccttggggaactcccgagctgactcagaggcttgaaaagcagcatccaccccctaccgggcatcagtcacagcaccccctgctccttcaggcacctgaccttgtacctacttattctaaagaagagaaggactttctccaggcagagggagggcaggtgatagaagagggatggatccagttatcagatagaagaatagccatgccacaactgctaggagctgcagtcgtactggctgttcatgagaccacccacctaggccaagagtcacttgaaaagttgttaggctggtagttctacaactcacatccggcagcccttgccaaaacagtggtgtatcagtgtgtcacctgctggcagcagaaaggtaggcaaaatgcaaatgtcccgcccagcatacaagcctgtggagcagacccctttgaagatctccaagtagacttcaccaagatgcccaaatgtggaggtaacaagtatttgctagttctagtgtgtacatactctgggggtggtggtggtggtggtgtggaggtctgtccaacacgaactgagaaaactcttgaagtaacctgtgtgattctccgagatctcatccctaggtttggactgcccttacaaatagactcggacaacaggctggcatttgtggctgacttggtacagaagacagcaaaggtattggggatcacatggaaactacataccacttaccgaccacagagttctggaaaagtggagcagatgaatcagactatcaaaagtaatttagggaaagtgtgtcaagaaacaggattaaagtgggtacaagctttccctatggtattgtttaagattagatgtaccccttctaaaagaacaggatattccccttatgaactattatatcataggctccctcccatactacggggattcccaggcactcctcaagagctaggtgaaattgagttacagtgacagctacaggctttaaggaaaattacacaaacaatttcagcctgggtaaatgagaggtgccccatcagcttattctccccagttcaccctttctccttaggtgatcgggtgtggatcaaggattggaacgtaacccccttgcagccattgtggaaaggaccccagaccgtcatcttgaccacagccacaaaggtagagggaatcccagcctggatccaccacagccatataaaacctacagcacctgagacctgggaggtaagaccaagccaggacaacccctgcaaagtgatgctgaagaagacaataagccctgctcctgttacacccagaagctggctggtccatgcctggctgaagcataaggaaactcattgtgggtctcattttccttaaattttagacttgtacagtaagtacttcaactgatcttcctcagactgaggactgttcccagtgacatcaagttactgaggtagggcgaaaagttaaaacagtctttctgttttataattattatgaaggtactggaactctaaaagggacttgtttgtataatgccacccagtacaaggtatgcatgccaggaagtgaccagcctgatgtgtgctataacccatctgagccccctatgactacagttttccaaataagattgaggactggcaactggggaaaagctgataagagtaaagtaatatctaaaacagaagagaaaggagttcccaaacaaattatcttaaaatttgatgcctgtgtggcaatcaacagtgacccgtatggaaatagaataagatgcggctgtctagattgggaaagtggctatatagtagaaaataagtatgtttgcaatgaattaggactgtatagtgatgaacatagttactggtcctgtgtcatttaggctacctggaaaaaagataagaaggaccctgtcctccttcaaaaaggaaagagtaactgttcctgcactagtggtcactgtaactcattagaactacctgatcaccattggaaaacaggagagtatgtaaccctaggaatcaatggaactggactggatccccaagtaaatatttaagtgcaaaggaaggtccacaggctctttcccaaaccagtgtttcagaccttttaataataatagtgttaggagcctgcatgttactcccctgtatgttacccatatttctaccaccttagttcatcaaaagacctcagcacaagtgtattacatgaatccctattgatctgtctcacaggaagacctgggtggtgactatgaaagtgagaactcccactagtgagtgaggttctcaaagtgggggaatgaggagagaggccatttatcttactgtctcctgtctctgaagagaaagaggaagtaaaagctgaaaaacaacaggaatgaaatcagtggcaagaccagccagtgcaccgatgaccaggcctgaggttaaaagattaacccccaactctaaccacatgtgctacctatagatctcaatctatcatgaccctttcacgtggaaccccttagagttgtaagcccttaaaagggccaggaaccctttcttcggggagctccattcttgaaatgcaagtcggccaatagtccagtccgaataaggcctcttccttctttaatctggtatctgaggggttttgtctgcagttcatcctgctacagtcccagtgctggtggccacaggagtgcttatgtcgcccctcccctaaatgcagacagcacagcatggagagagagagagactccatttgtttgggggagagtgaaggaaaagaacaagagcctctgcctcataatccagggaattctgccagatcttactgcagaccaccaaggtggtacatctgtgagtttgcaagagtcatagtgttactgggcttgagatgcctctaaagcagatatggctgcagtgaccaaatacttagatcacaaccctcaattccctttgaatactgggaaagccttctcaaggaggatgggaggctgggcatggtggctcatgcctgcaatcccagcactttaggaggccaaggtgggcagatcacctgaggtggggagttcaagaccagcctgaccaacatggagaaaccccgtctctactaaaaatacaaaattggccaggcgtggtggcacatgcctgtaatcccagctacttaggaggctgaggcaggagaatcacctgaacctgggaggtggaggttgcagtgagccgagattgtgtcattgcactccaacctgggcaacaagagtgaaattccatgaggaagaagaaggagaaggagaccagatgtggtggctcatggctataattccaacaatttgggaagctgaggagggaggatcacttgaatccatgagatcaaaaccagcctgggcaacatactgagatcctgtgtctacaaaaaatacaaaaatcagctgggcatggtggcatgtgcctgtagtcccagctacttgggaggctgaggtgagaggatcgcttgagcccaggaggctgaggcctgcagtgagccatgatcatgccattgcactccagcctgagtggcagagtgagattctgtattagaagaaagaaacaaacaaagaaagatgggtacacacaagcacagactgtggagattataataaataactaattctttaatggccagacattgaccaatagccacaagcatcaagagcatccaggaaaacatgacctcacaaaattaaataaggcatgagtgtccaatctcagagtgacagaaatatgtgatctttcagagaaaaaattcaaaatagctgctttgaggaagctcaatgaaactcaagacaacacagagaaggaattcagaatcctatcaaatatatttaacaaagagattgaaataattttttaaaatcaagcagaaattctcgacctgaaaaatgtaattgacatactgaagaatgcatcagatctcttaccagcagaactgatcaagcagaagaaagaattagtgaggttaaagacaggctatttgaaaatacacagtcagaaaagacaaaataaaaaagaattaaaaactataaatcaagaaataaagtaaaataaaaacaatgaagcacacttactagatctagaaaatagcctcaaaagaacaaatctaagcattacaggaggtagagagagagatcagcatagaaaatctattcaaagggatagtaagagagaactttccaaacctagagaatgatatcaatgttcaactgcaagaaggttatagaacaccaagtagatttaacccaaaggagactacctcaaaggcacttaataatcaaactcccaagagtcaaggatgaagaaagaattctgaaggaagaaagagaaaagaaaccaataacatgtaaggagatccagtatatcttgcagcagacttttcagtggaaacattataggccaagagagagtggcatgacatatttaaagaattgaaggaaaaaaaactttcattctagaacattatatccagtgaaaatattctgagatcaggagtttgagaacagcctgaccatcatggtgaaatgctgtgtctagtaaaaatacaaaaattaactagttattgtggtgtatgctgttaatcccagctactcgggaggctgaggcaagagaatcacttgaacccagaaggtggaggttgcagtgagctgagatcacgccactgcactccagcctgggtgacagagtgagactgccacaaaaacataataatagtaataataaaagaaaaaggcaaaaattcaaacaacagaaactgggcaaagccctccacaaaagaggaaatgtgaaggaatagctaataaaaacacgaagagggtctcagcctaacagggggagatgtcacgtgacacccaccagactggcaaaaatcccacaacccaatccatgcaagagttagggagaatggagagtagcaggaacaccaggcactgctaagaacggttgtgaaatatatttttgttatgcttctatatgaaagggtgtgtgttgtgggttatgagaaaaattacatttcttacctgggatgaaattttaaacattggaagctattgaccagaagaaacttgcacttttgtacaaaagaaatacccaagaacattcctaacaaaacagagtcctaaaggccccaacctggccaaacactcatcaacagggaaatgaagacatttcccatgctcctctcatatgaccggagatcatgcagcaataaaaatgaatcatgtcaatgtgggtgggtctcaggaagagaatggaggacaaaaatagacatcgagcagatgctcagagccatgcagtgtaggagcagccacacaggagaatttctcacatcaaagttcaaaactacagccaaggcaacagagcaagaccctgtctcaaaaagacaatggaaagttccaaaactaaatggcatattttttagggatgtacacataagtggtggaagaaatgtactatgaagaaaaatatgggaataataaagactaaaagaggaattgattccctctgtaggagaagggaaggggctagggctcaggcagggcctccggggagcatccaaagttatgtctcttcagattctattccctaaacttggtggaggtcctctgtgtccaatgtgtctgtattctttataccttacccatattgtacaaatgctttatttctattcaacatttagaagacaatcataaacaaaatgcattaaatagcaagatggcaaatgaacctcaggaaggaacatcaggaacatccatgaggttccatccacggaacctcaccatggatacgcttgtgatcaagggccttgtctcccctcaagacagtcagagatcagaggctgccctcatcatagcagtggaacaggaccagctgggacagggtccttctgtgacacctgctgtgtcaccaggctgtgcgaatggactcagctgcccgaactcacagaatatcagtaacagcaccgaaacttcacaggaaaaatggtaagttgtaagtttctccattaatagtaactctcagattagtctatgtcatccatcgcttctccattaaataactttttatagctttacatgggtcgatttttcaatttatattttattttactaactgaatgaaaagatatatattgtgtgtggtgtgtgattttgtctcagtcaggataatcatagtttaatttctattattattataccaatatcatttagtttttttaagctgttcaattcctgagggtattaatcagggtctttctgtctcatgagacaaaaaacaaatccaaactgtgtaagagaaagaagaatgcattgatcacgaggactgagaagctcccaggcttaacttgcttgggattcagctacatgtacagtttcaagtggtgtcctgtaaactctctctctctctctctctctctctctctctctctacttccccaacatctgctccatgtttagctccacgaacttcagacttaaaaagcatcactggctcctgaccaggattccagctccatgaacctcaaactagaacaccagcccggcttctctgcaggtctccagctccaaaacctaagacatcagtggcagtacaaactcatcccaggggctccagctccaggaccctcagacttgaaccgcagcaccaactcttccctggatctccatctccatgaccctcagacttaaacagcagcagcaccagttcatctgtgaatctccagctccacaaccctccaactagaaacacaccagctcctccctgggtctccagctgcacgaccctcaaactacaacatcagctcctccccgggtctctaactccatgaccctcaaactaaaacaacactgctcacccctgggactccagatccacaaaccttacactagaacagaaacaccagctcctccacagatctccagctttacaatctaagacattagtggcagcaccatctcctcctggggtctcaagctccaggaccctcagacttgaatcgcagcaccagctcttccccggatctccagcttgacgaccttcagacttaaacaacaaaagaatcagctcctccctgggtctccagcaccacaacccacaaactagaagaacaccactcccccatggatctccagatccatgaccctcacactagaacaccaacacctgctcctccgtgggtctccagatccacgaacctcacactggaacaccaacactggctcctctgcgggtcttcagctccacaacctaagacatcagtggcagcattggctcctcccatggattccagctccaagaccctcacatttaaactgcaagaccaccttctccctgtatctccagctgcacaaccctcaaactagaacatcagctcctccaatggtcttcagctgcacgaaactcaaactagaaaaacaacagctcctccctgggtctccagctctgcaaccatcaaactagaacaccatcagctcctctccaggtctccagctccacagctctcaaataagagcaacatcagcttctccctgggtctccagctgcacaaccctcaaactagaaaaacaccagctcctgcctgggtctccaagctccatgaccctcaaactcgaacaacatcagctcctccccacgtctccagctgcatgaccctcaatctagaaaaacagcagcaaactaataaaacctccccgggtgtttctagtttgagggtcatgcagctggacacctgggaaggagctgattttaatctagtttgagcatcgtggagctggacactcagggaggagcagatgtttttctattgtgaggattttggagctggagatccagggtggagcagtgttgttatagtttgaggtcatctgagggtcagctgcatgacccttaagccagaaaaacaccattttccccctgggactccagctccacaaacctcacactaaaacagcaacaccggctccttcgcaggtctccagctttacaacctaagacattcgtggcagcaccatctcctcctggggtctcaagctccaggaccctcagacttgaaccgcagcaccagctcttccccggatctccagctcgatgaccttcagacttaaacaacagaaggatcgactcctccctgggtctccagcaccacgaccctcaactagaacaccatgagctcctccctgggtctccagcaccacaacccaaaaactagaagaacgtcactcccccatggatctccagatccacaccctcacactagaacaccaacaccggctcctctgtgggtcttctgctgcacaatctaagacatcagtggcagcattgactcctcccatagattccagctccaggaccctcagatttgaaccacaagaccacctccttcttggatctccagctgcacaacactcaaactagaacaacatcagctccaccccgggtctccagctccattacactcaaattagaacaacatcagctcctctttgagtctccagctgaaagatcgtaaaacaaggacaacatcagctccttcccgagtcttcagctgcagggcactcaaactagaaccctcccccgtcttcagctgcacgaccttcagactagaacatcagcaactctcctggtctccagctgcaggatactcatattagaaaaacgccagctcctcccgggttctacagctgcatgaccctcaaactaaaaaacacccgctgctccccaggtctccagctgcatgaacctcaaactagaacaacatcagctcctccccgggtcttcagttgcctgaccctcaaactagaacaacatcagctcctctccaagtccccagatcacggccctcaaactagaacattagctccttcccgagtcttcagctgcaccaccctcaacctagaacatcggctcctctctgggtctctagctgctggacactcatactagaaaaacacaagctcctcccaggttctactgttgcacgaccctcaaactaaaaaacaaccgctcctcctcaggtctccaggtgcatgaacctcaaaccagaacaacatcagctcatccccgggtcttaagctcatggccctcaaactagaacatcagctcctccctgagtcttaagctgcacaaccctcaattgaaagcatcagctcttctccaggtcttcagctgcaggacactcacactagaaaaatgcaagctcctcatgggttctacagctgtatgaccctcaaactaaagaaacaccagctcctctctgggtctccagctccatgaccctcaaactagaaccaaatcagctcctctttgcatctccagtcgcatggctctcaaactagaacatcagctcctctcctggtctccagctgtaggacactcatactagaaaaacgccagctcttccccggttctacagctgcatgaatctcaaactaaagaaacacccgctcctctccatgtctccagctgcatgaacctcaaatcagaacaacaccagctcctctctgggtctccagctccatgacccttaaactagaaccacatcagctcctctctgggtctccagctgaaagaccctcaacaagaacaacatcagctcccctccaagtcttcagctgcacaaccctcaaactagaacaacatcagctcctctccaggtctccagctgcaggacactcatactagaaaaacaccagctcctcccgggttctacagctgcatgaccctcaaactaaaaaacacccgctgctccccaggtcttcagctacatgaacctcaatctagaacaatacctgctcctctgtggatctcaagctccatgatcctcaaactagaataacatcagctcctctccaggtctccagctgcagtatcctcaaacgagaacatcagcttctccctgagtcttcagcggcacgaccctcaaactagaacatcagctcttctccaggtctccagctgcaggacactcatactagaaaaataccagctccccctgggttctacagctgcacggccatcaaactaaagaaacaccagctgctctctgggtctccagctgcaggaccctcaaaccagaacatcagattctcccgggttctgcagctgcccaaccctcaaactaaagaaactcctgctcctcccagggtctatagctgcatgaccctcaaactaaaaaacaccagctcctccccagatctccagctgcaaccctcctattgctcctttgtttgttacccatatttctccaacttctaagaagttttgttactaccttggttcatcagaaaacttcagcacaaatgtattacatgaatgtcttgtaatacacaagtgtattacatgaatcactgtcgatctgtcttgcagaaagacctgggtagtgaagatgagagtgagacctcccactagtgagtaaggttctcaaatgggggaatgaagagagaggttaaagattagcccccctctaatcacatatgctatctctgaatgtcaatctatcacaaccctttcacgtgaaccccttagagttgtaagttcttaaaagggccaggaactctttcttcagagagctcagttcttgacatgcaagtctgctgatgctcctggccaaataaagccacttccttcttaacccggtgtctgagtggttttgtctgtggctagtcctcctacaccaccatgattctaactttcctgaggttttctcagaagccactatgcttctcatacagtctgcagaaccttcagccaattaatcttcttttccctataaactacccagtctcaggtatttaatagcagtgaaagaatggactaatacttgattattccagctaaacaaaatcaaagtagacaccatgccattgttagcaaattcaggctaaatcaccaaccaaaaatatgtgtgaatgtctcttgcaatatgtgtaatgcatctttgtgtaatatgcatatttgaatacaatttatatttatgttttctgaagagataaaatcattgggattcttttacattcagaatccatgaaggtccttgaactagaaggtatgattaatttcaaaataaatttgaaaattagttcataagtcaatggcaaaattaacataggtgggaattaatgttataatttcatatactgctttcataatttagcagtttttcatactgggaaaattataaataataataggaaatatattaatataacaaattgtatacttctggcccaatttcttcttcttttctgagaatatataattactatttgatatagattttttatgttagccatagacaatccttaattgaaaaatcatttagacaatctctcaaactttaagttaattttctatgccacattttcttaactcatcaaaatatgcattatattgattttcaattaatttattttgaaatgaatgaaataaaaatgtgaaaaaagttatccaaaatgaaacaacagtataggatgattaacaagattaacatattagtcaatataaaattccactgctatattgccatagctatggaactgttgtgatatgttcattctactaaatcctaatatttaaaaaaaaaaaaaagaaaaatgacctccagtacatatagaaaattggttgctttagtatgcattaactaattttgaagaaatagcaaagaaatgttcaaactttctttgttttattaaaacaatgctgtattgtgttagactattgaaaaacaaaacgaatagggacctgtattctttgaactgatgagcttcttgaaaatagaataaataaccctggcattggacttttaatatggtattgtttaaaggagcacttttggctagcaaaattagaaaggattttttattttttcatcctctatatatgctgttcctttctccagaagacaagccaatggtatgtgaaagagctttaaatttttcactcaaaataatcacgtagagataaaaaagaaccgaccttctattatatcaccggtctaagagaaacgtgcgttttaacttcaccctcaacagagtaagctcttgtggccttagtgcttatcatgcattttcagtagggaaagaaaatcacaatgaagaacaaaacattttcaacttttaaaaactaaaagagggaaaatttaaggcagaactaaattaagtagcaataaattagggctggtttagttggtggtttccaataagctctacagccacttccttcaccaagtacatgagtgttgcttcagcaatcattcctttaattcatgtcctttctctctctagaaaaactcatatattcattatcctaggagtatcaggtttgcaaagctggaccaaactaaagactcttcgaggtgcactttggcttcttaaaagagctaccaagattttggctgaggcatgtgacttaaaactcagcaggtatgattggcaagctatcctgtgaaacttgtaatcaatcaccatcggttttagtgaattgtattatctttgttcttgtaaacactttctttcaagttatcattgcttgtgattgaatcatgagctcttagatttctaagggaacagaaaacctatgaaacatttgaagcacttttgaaaagaaacttcgtggccagaaactcaccaaaacctgaggaaatcttttttattttgaaataaaagaatgcttcctttgtgtttctgtccttgaatccagttgttttacttgagattatagcaaagtcttctctgtcttttatataatgattctttaatatttgacctattcctcttcccccacctcatttatgagttatgtctattccatcttaaacattctcaggttcttaactgtatctgctactgtaaatggtagtttagtttttgttattttgattttttttgtttattttggtttttttctagctttattgctgtataattgacaaatagaaattgtgtgctacgagttgatgtgtagctattcatatatgttctgaaatggttatcacaatcaagttaattaacatatctattactttatgtagttaactctgtgtgtgtgtgagtgtgtgtgtgtgtaatgagaatatttaacacctaccctattggcaattatctccctattttcctttcccccaaccccacccttctactctgtgctgctataaatttgactattttagatttcacatgtaagtgagattatgcagtgtttttttcctctgttggattatttagcttagtatcatttccttctggttcatacttgttattacaaatggcaggatttccttctttttcaaggctgaaaaatactccaatatatttgtgtgtgtgtgtgcatgcacgtagaatccttcatggagtcatttatccattcctccattaacatttaggtttccctgaattggctattgtgactaatgctgcaatacacatcggggtggaggtatctctttgaggtagtgattttatttcatttggatatacatccagaaatgaaactgctacattttatgagttctaattttattttttgaggaatttccatactgctttccacgttgactgtattaacttacattcccaccaatagtttacttgggttttcttttctccacatctttgctaacacttgttatcttttatctttttgttaatagccattctaagaaatgtgaggtgataactccttgtggatttgatttacatttccctaatgcttagtgatatgaaacatttgtttcctatacctgttggccatttgtatgtcttctttggagatatgtttagtcaggtcctttgcccatattttaatagggtttttcatttttttcactatggagttgtatgtgttccttatatattttagatatgaaccccttatttgatgttttgaaaatattttctcccatttttcaggtgtgtttttatcctattcattgttttgtttgatgttcagaagcttcttagtttgatgtagccccactagtctatttttgcttttgtagcctgtgtatttggtgtcatataaaaaaaattgccaagaccaatgtcaaggacatttttttctatgatttattttactagttttacagtttcatgttttatatttgcatatttaatctgttttgaggtagtttttgttcagtatatggtataaaataaggtttcagtttcactcttttgcatgcggatattcagatttcccaacatattttattgaaaacaatattccttccccactgtgtattcttggcacccatgtcaaagattagttgagcatataggtgtgaatttatttatgggttctctattctgttccattggtctgtgtgtctgcttttatgccagtacaatactgttttgattactatagttatgtaatacagtttgaaaccatgaagtaggatgcctccagcatttttttccttgctcaagattggtttgactattcaggatttcttatgtttcagtataaattttggtttccaaatccaaatactgtttaatatagtgaacaaatctttgttttctttctgaaaccatctttccaatatatctcagaagtcagtggtcttaatgaattggtgccaccatctttccttgctactcaaatatgtgttacataaatttgaaaattatttgaaagaaaatggccaaatatatctccttcatatttctccttcatgtgtttttttatcctgaaaataaaactgcaagagggaaaaaacaaggaacaagcaacaataaagaaaaaaaaagaagtagagactaggtaactaagagcaagataaaaaggtgagttttttcactggaggattggatgaaagaactaattaatttgtctctcagtttgagcttttcaagagttctttataagtccttcatactgtgacatgatctgttagccattttcactgtggtccccattctagaagcattttactctctctctctctctctcttttttttcttttttggcgggaatgggggatgggagtaggggaatggagcctcactctgtagccaggctggagtgcagttgctgatctcagcttactgcaagctccacctcctgggttcaagcgattctcctgcctcagcctaccgagtagctgggactacaggcacgtgccaccactcccagctagtttttgtatttttagtagagatggggttttaccatgttggcaggatggtctccatctcttgacctcatgatccgccctcattggcctcccaaagtgctgggattacaggcgtgagccaccgcgcctggcagcattttactctctttcacatactttcttatatttatccttagttttttgaaaatataagagtgacattataaggaaaacttaaattgtgagtagctcctagtagaaatggcctcctacttgacttttctctcctgttttgcctcaaatcattcttcctggttaattgagtatgatttctaacatgaagaaacttgacttctggctattagcaaaaaacggaaattttttctctattgttatattatcatatggcttcagctcatggcaacacattttcactttagtcaattctaacagcatttggatttagcagtgaaattgtttgcatctttcattgataattttttccaaagcagtgtaaaataaaatgtggttttgatctggaatcactttttcctacatgcacatgcacacccacccacacacacattattaggtgctcacatccttacaatggcacaaacaactttgcactgaaccctttactagtcacttacacttctcttgacttgaatattctgcttatttatcagtgtaatggtttttatccaaataaagtaaaacaatagaattcaggccaattagcctttatatccttgttgaaaatatttaatattacaaataattttgtttttatttagtcctctttaaatttgtctttcactgtataagacaggcaatatattcatgtttatcatgtcaaaaaactgaatcaaatgttaaagtgctttaagaaagcaacagtatgaaagctgatcaagcccactgtggtctgcatcttctttatatgatatactgcctttcagaattttggagatgttattaaaaaatcaaatttttgaggtcattgatggcatagcatgtattacattctttatctcttcagttactagaactaaaacactagatcgattttatatgtatgtatgaattgataatctcaaatttttacatttttaatttaaatatttacatgtttaaattttcatctcttttctgctttttttcccaaaatatattgtgttccttagttctatgtttatatttaggaatgaataattgaacaaactaatttaggcagcttgagtggatgtcctcttcacatacttgcctctaccccagaacatgagaagtaactgtcagtaattattggcaagtattagttttcagagatgtgagcaaggaatggacatgccctatctccagcctacgtgtatcctcaattaaaaatgatttggattctgttccatgtctccatgcccactcttggatccccaattttgggcagacagatcgatcaatttctttagaatatattaatctggactcagcatgaaagaaaataccccattgcaaatatggcttggaaggcagaatagtttatctaatttatatacccatcttctcaaatctgagatctctgtaaataccaacttccaaggactcttttgtgaagagcagctttctccttcactgactcctttttctgctaagtctatgagcatttcagttcattcctaaatgtgatatcatttgccttcctactgcaaggaatgtctttgtctcctggtatcttccttttctcctattcttaatagatttatgaattattctctattttaatgtcttgtggttacgggaatctcatggaagttgacacatttctcaatatgtgttatatgttggatcccatcacattgctcaatttgcatttcataattgtgtctttggtacttgttcatcttcattgtgttcctagcaagcaaaaccatccccttagcctaacatcactgtaacataaataagcactcccctagtttctatgcatccccaaaataaattcagcttcatgtaaatatgactattgataaagatgtccacttattgaatacacttatcaaaagatttttctggtgtaacatggatataatttctgtcttaagaactctaattctaaagaaacctgtgtatggatttcacctttaggccttagtttaaacttatttaaatttgtcttcatagatcttaccctctcaagctattctgttttatgacaaagaccaacactaaggttttttatatttatatatgtgaactgaaataacgttctaaaatattttaaatcctacaaattagtttctttcattaaacagaatcctttctttgtgttggacattaattcagtgttaatgtgaatataattgtcatggattaatattaaatatttgccaatatctccctttacaacaggattttttattaaagtgtgtggatgtctttttttctttataatgtcttaaaaagaagaaaactttggtcatactataaaagttgagtctgataatgttttattatctgggaaaccatttaaaaatagtttcattgttattaaaatgacatctgggttacatgtgaataattattaaaataattatagaacaacatgcatttgtgaggaataatacaaagagattctgtatacactttgcccagcttcccccaatgacaatattttgttaaactatagtgtaatatcatgacaataatattgacattttacagtccgtccaacttactcaggttaccccagtttggcttggactcatttgtgtgtgtatgtgcacatgtacatgtataaattctatagatttttattaatgtgtaggtttatgtatctaccatcacagtcaagacactgagaagttccatcaccacaggaattccctatgctaccgtttgacaaccatgagaaagcatttttaatatatctatttttacatttgggaagggtcaaaagtcctttcattagcccagctcctgtccagataatttaaattaatgatgtctgtgttcttgtatggatggcatcactgcttgaaatatagatctccagggtgctcctgctctcactctttctgagccatgatctattgcatgtctgtacatcatcaaagcaaattgcttcttcaatgatgtgtaagtataatacatcatcacaatgggacatggtgataatgcattacccagaaaaagatgactgtcatatttgacagacaaggtcaaggagcaaattcaggcagccccagcacatttcatcagcagcattcttggtatagaagaaagtttgtttgcttagaatgatccacttgaaatgtggacaaggctaaatacatacgtatgccctgggttgattcctttggtaaattaaaaacgaggtggttgagcttccattaaaatgacatctggatgacatgtgaatagtttttctgtccacagggtgttttgaatcatgtgtgtttcttactcattcagcatcaaattgttttccagagaaagctcttcaacaagattgcaaagtccttcagggtagtaactgtcttatacatcctttgtttctttcacagtgtctaaagcattgctgagcacatggaagacactcaataaatactcgtttaatggaattgaatttgtaagcaccagagactcatgcttccttttcacatagcttgacacttggctgcccaggatccttgcatgcaaggtggtaaggttactgtgggaaaattctgttggcttactatcccatttgctgtctgctctttctttgtttcttcctcctttttttttttttttttttttttttttgtagagtctttcagccaggagctatttttataaagaatttcattttttgctcatgaggattaaacttttaagtttggcttcagggtgtgagagaagtacaacttatgaaggttgctctgcactgcaaaaaggataggatttgaggaagggatgtttctgacattggcacagcagtattccgttctcccccatcccccagttgctgccaaattggcctttctttaaagcatacagtatttatttctctagtccttggatcatagcaattttatttcaatgtcaccagtgaaggagagaaaggcaatattttgtccaagagtgggatttgaaaatgagtcctctgaggatatgttagagcaacctaagtattagatgctggaaaaatggatcatttcttgatatttcggtaggacacatctccatttcaaatatatgcatgctacaatgcagtgaatacatagtgcattttagtcagctctaaaagtaaccaagccaaattttatacaattgatacagacaatgggtgttcaagtgggaatacatgttactggctctctgccggcatgatgaaatagaggaggcaaatagatacagctcacgtgccaattctggttgctcagtcacagttatatcaatatcatgttgataaaagttataaatcagggatcaatttgcaacatctaccaggggcccaagtagaaacatgtggtatgcatgacagttatgaatcaaccctggtggaggaaaaagatggagagtcatggaccatacgcctaacaaagtaattgtacctggtccaattttggaccatgagtaaaccatttaataaaaatatatcatagaattgttttgagattacattttaagttgcataagctataatgtttgttatgattatgctaattgtatatatcattagagaaaataatcactaaatattttgaaacaaaagaaacaatgaatttaagtaataaatataatcccactcagccagagacgacaagttattgatactcttgtagatacatttattatataaaaacaaatatattatgtgatttatattttatcttacatattattttaatatcgatatttttctctcataatacacctttaatatatttcaatttcaaaagataatttctgaaaaactgtttttatatttgcatggtagttaattatatggctatacataatttttttaaacaaacacctatatttttacattgaagaaggatctaaattttgtatatgaatcatactcatattaaatatttttgcaataaaaatgtttctacttctttagtaaaatcccaaaggctgatatattggatcaaatgttctacagatttaatgggatttattcagtacttaaaaggaattgtattaaattaaactgcacaaagtctgtgccaaattatgcacctgcaaacaaatgtatctgattagaaggcagtgcagtaagttcttttaaaaggcttgttttttaaaaaatgaattagctccaaaactatttatatattaaggaacaatttgagcatgacacaaatttcttgtttgcctatgtgttacctcatctttgagaaacactaggcggatgcacaaaatggcacctggcagaacaaagccatgtagcaatacataaaatgtaagcataaacaaacctcaaacatccaacagctacttcagctcagcacaggtgtgatgagaccacccatctatatctggtgttacagctttctgtctgatttcagataattcttatttcaccactttgcaattcctcccaagctgaaaccctttcaatactcacttccacaagcaaaccttagtttttcttcaaaaaggaagtgtcatatttcttttatgaaactatatatttctttaccacttaatatggataaaagtatgctactatttttattaggttcctatgattttcttctgtgtatgtcactgaaaaagtttttgactattgtttcccaacaccagtctccccataagccatgtaatttttttttcataaatttgcatcgcaaggtgaattttaggaatacatcatataacggagctgattctttatgtgtgtatactttctgaaagattccctatgtgagataagaaaaataaaaagcgttttccttgctctcatattcaattcaaatttatgaaccagatgtattggttccccgtgacacacaacaagcagctaattctctaacagataccaactgggtatactataacttagctcaattttgacactatctacctagaattattatcagatgctacaggttaagcactcagtctcataggactaacctcaatttaaaatgccaattgcaagcctggggttttgacctgtgcttctgagtgattggctataaatctgagttcccatcaccccttcctcagattcagctaatttgctagagaagctcaaagaacttagggaaacactttacttagtttacccattcactataaaatacattacaaagaatatagatgaacaagacagatgaacaggtgcatttttaaaagagccagggcaacgtatgaaagctatttacccaccctcccaggcacctccagggaaccccgacttttggattttttatagaggcaacattacatagacgccattgattatatcatttgtccttggtgatcaactcaaacatcactccctctctcttccctggagggttggggtggggctgacaactccaactctaattatgccttggtccttctggtgaccagcccagtcctgaagctatctaagggtcccaaaccaccaatcatctcattaatatgcaaagacacatcactctagaaattccaagggttttcagagctgtgtgacaggaaccagggtcagagagcaaatggatagttcttattatatcataatatcacactccaataagtcaacacttgcctcattcaagactgattctaataaagaatgataactattatttttcactacttaaagagtcagacctatgtggaagttgcactaaatccagttacaatttattccaccacgaagcttggaagctctatgacccttaatacaatgttaatgtgaaagttttatattgtctgcaaaccaaaaactatctgagactggtctcaattaatttagacatttattttgccaaagttaaggacagtgcttgggagacaagactgtgtctttctccaaagatgattttgagggcttcaatatttaaaggggaaagggcaaatgctggagagagagaaagacatttttaaaagctgtgggtagttaagaggcaagcagttgcattcttctgagtctttgatcagccattcacatgtgacagtagggtagaaaaatcgtcacttatgcattcatctagctcagtgaatctacattttttacataaaataaaataaacttaaggctgaagaagcaatcagataagcatttacctcagatgagcgaagtgaagactttgagttctgtcctttgtcctgtatttgtgaagacaagctatcaatgtacatggtcagggtaaaattcaacataactgtctcaggataaagatcttggggcccacaaggaatttgctcttgggaaaattatgagggagctatgtagctttttcatgtttttagccatcttagaaacaaaatgggaggcaggttgcatgacgcagttcccagtttaaattttccttttgactgagggagtttggaatcctgagatttattttcctttcacatattttgctcaatttattcatgaactgtgattttattcaaaattattttattttcaaattcattgcattcaaataatcataaaatgtgtacctgcattaaatgaggcagtgttgttctttttcttccttcatttacaaaagcttttttccacttttttcattgaataaaaaagaaacttagttatggctaggataaataatgtaatatgtgactattttgccagttatgtttcttctactgtgaatagcctatgccataaataacccatttttcaaatgagcaggcatttcttctattattagtttgcatgagctctttaaatatatcttatgtagcaattttcagttggttagatacatgagtttatccctagcttttctaatagcactatttccaatgttacacacacacacacacacacacacacacacacatacagcactcacttataagttgagtgaactccaggtaagataaaccaaagaattccatgccaagagacatttacaaatcttgaagagccagagaaaacccacaccgtacctttagagataaataatacaaatggcagtagatttcttatcagaaaccatggagtcctgaaacaagtggcacaatgcaatgctgaaagaaaaggccttttaattgagcatcctagacccagtgaaaatgtcctcccagattgaaggggaaatcaagccattctcagatgagaaaacattaatttgttattatcaaacctaccataaataatggctaaagaaatttgttctctaaacaaaggaaatgacgttccaaaaatcttggaacatctgaaagaaagaaacaatacagtaagcaaaacttttgtaaatacagtaggatttgttgagttttctaaaatatgtttgatggtagaagaaaaaattataactttgatgtggttctaaatgcatgcagaggaaattttttttttttttttgagatggagtctcactctgtcacacaggctggagtgcagtggcaggatctcggctcactgcaagctccgcctcccgggtttacaccattctcctgcctcagcctcccgagtagctgacactacaggtgcccaccaccacgcccagctaatgttttgtatttttagtagagatggggtttcaccatgttagtcaggatggtctcgacctcctgaccttgtgatccacctgccttggcctcacaaagtgctgggattacaggcaggagccactgttactcagtaatgcgatggctgggtcaaatggtattatttctagttctagatccctgaggaatcgccacactgacttccacaatggttgaactagcttaccgtcccaccaacagtgtaaaagtgttcctattgttgtttcctgacctaccgtctggcactccccagtgagatgaactcggtacctcagttggaaatgcagaaatcacctgtcttctgtgtcactcacactgggagctgtagaccagagctcttcctcttcggccatcttggctcctcctcaatattagaattttctatccttttttgtgactcatttttctctctgtgttaactacattctcttcaactacaagcaatttcctccacgtggctgaaaaaggtgactgcagtcaggtctatatcgtagtggtcatttattctaagaacacttatggtttgtaaggtcaagttagtgacttgattgtatatgaagtagagtcaaccccacacaaattacatgaaatgagagcgaggggatttttccaaagatgagaacaatggacatgcttcatgtctatttgtgtcttcagtcagtcagttttcagcatgtaatgtacattcccttcagagaaaacaaatgaactaacattttaaagactggactatggagaaaataaaagctaatacccaacctatttgtttttacatttggatttctccccattcatatgttgaataggaaatttcacgtttcttaaatagatttttaaaaagtatttaaaatacgatttcctcaaatctttgcacgtattttttctggttcattttgtttcacatgctagagaaaaataaataccagctacaaatatgaagcagaaattgtctattgagcattggtatcaaattttctactgagaacactgaaaacattatctcatttaaatatatatattagagtcttaggatggtcataacaaagtaccatagaccgagtggcttaaaacaacagaaatgctgttggatcactgttctggaagcctgaagtccaagttcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgactcgagttgctgacagggcaatggtccctctggtgtatatagaggaaccttccttgcctcttcatagcttttggcagttttctgcacacctttgctgtcccttgaagctgcaaaatccagcctcttcgttgccacattgttccttccttgtgtgtatattggtcttctcatggccacttcttacaaagacaccagtcgcattggattaggaaccgtccttactctggtatgacctcatatttaccacttacatccacaacaaccttttctacaaataaggtcacactttgtaatactgaaggttaggaaacactgggtgtttggacttcagtatatctttttgttgttgttggggggatacaattcaactgataatactgtggggctaatataactcacattttacagatgaagaaatttgtgcatattgagtcatttacatagtatcacaagtaacagagccaggatttaaacagattccatctaccactgaaaaaccacacacagaccagttattcacctcactacttcctgcagccgataactgttttccattgcctgaatagggtataactgccaaaaataagaacaagaaaaatgtatgaaacaagaggactttcatagcaaaagagacagccactgtatagaacccagcacactgcatttttcagaacaaaataatagatattttaaaatgaatttgttagccaaatagaaagtaaagtctggggcaaatatctctaccacatagataatccactgatgacttacagttcagttggacatataaaatatgatagaacttttcaataattatccttaaactctagaagaactttgaggagtccttgttcatattgcttttctgaatataattaataagattattaagatcagtctgcagcagtttccttgtagatggaaaagttaattctcagttcagggtataaacgagaaagaacataattactattattggactaattttcctaataaagttaggcttgctagcccttagtacaccattgttaatttatacacatgttgatgaaaggcaagataagtaaagtctagtgagtttggaatagtttagaggtccccctcaacttttaggtatgtgaaggggatttttaatgaatgcttttaagttaacaaggaaaagaagggactgaatgatcagttttttgtattaggtggtctgtttcccactggaaaagttgttatgtggctaaagagcctggtttaaataaaaacaaacagacaaatttatgcagaaagttaacgaagactaaaaaccccagtgcccattgtgctgggacagcagatgccatcagcagatgcactggagtttactccagttctttactgagcccaactatataatggctatgcacatttaaatactttaaacacaaaacaggtaataaacacgagtggattgaaacaatgggcaacatgtgtggatatgagaaagtggagcgtgtgagaaaaagtcttttagagctaaagtgcaagcctcttctaaagccattaaaatcctttttgttttttctttttgagatggagtcttggctgtcactcaggctggagtgcagtagtgtgatcttggctcactgcaagctccgcctcccaggtacaagtgattctcctgcctcagcctcccgagtagctggaactacaggtgtgtgccactacgcccagctaattttttgtatttttagtagagatggggtttcaccgtgttagccaggatggtctcgatctcttgacctcgtgatctgcctgcctaggcctcccaaagtgctcggattacaggcatgagccaccgtgcccggctaaaatccatttcttacccctaacatgctgtgctagaaataaaaaagcaactctgaggccctaatcagattccgtagtctaccaattcgatctgtcatcttcagaactctacactaaacttctccaacatataatcacagaaacaacacaatagttacaacagcatgaatgttttctatatcatttcaagtcttccacaccataaagtcactaagaataggaaattcatatttacttatacttgcccattctcatttctaatagaaaaataatatagcaaaatgatttgaatgcctacactttcacaatactcactgacttatttgtaatatgaaacaaaacaaataaaaactaacctagtgacccattcatatatgcatgctttctaaaaggttttgtttttgtttttaatgattctcatttgcttaccacatcagtgttgcaatgttagtcatctggaattctagaaattgggggaaggaaaaattagaacacctaccaagttaagctaatagaatagtattttgtaatagaaacctaaaggtacatagaagatagatacggttttatcaaaataaactaccaaaactatactaaggatagggatggagaaaggaacgaaatcaagctttcaaatgactctggagagggtggttggaaaaggctgaaaatcattcagtaacatttctgaacatatatattcatacagaggaaataaagaaagtaaccctctaagataaaagaagctaggagtgttaactgctataaatatgtgaagagaaagaaacatcaagaaaagaagaatttttaaaaatttcgtggactgggaggagaaagggagttgatatttaaaaagacattaggtccatggagggtgccctccagatgttcccaagtcttgggcattcagactctaatcctttgtatgatgcataggaataaattagccagcctcttgttacccacagtgtgatttgtaaagcatcagcttcaaggttatcctggagcttgatagaaatagagacctggcggtgtcactccctgcttaacaaatgagaatccacattttcagaagaccccaggtgattcctatgcacatcaaactgtgaagagcactgagccagactacagagtgcaaagccctgttctaagccacagtgatgctgactctcctcaccattttctctctcaaggtcctgactgtgggcaaaatatagaatcttagagcctggattatagcagttttacacaagcagcacactgatggaagcagctacagaggaaaagagaactggcagctcttgaactttcaccctctttcagaattcttaaaaattcagagagctgttctttaaagagacatttttctctcagcagttgaatctttgtagtctgacttgtgagaggacgtcaaagacttcctctcaggagtcagttccctgccattgcacccagctccttgcctagccttcttccacatctcctttatcacaggggcctcaaaactatagatggcagtgacttggcacggaccatacaattctaaaaggaagtcaacttagtgttatacttccacatggaatctgcgtttctaaagtagaggatagcattgaatataccaagaagtttcttcccagaaacaaaaccccgttctggatatagtgttaagaggaagctgttcctgtttcatgaggtcgtaatactcagatcggtgtgctgtcatcagccctgttgaatacatttccaaatcctttaggcttttgtcttttgccatactctagaaagtaaaaactataatcaaactcattttcttcgcccctttacgtgaattaatgttataatcaattgaactgcatggacatgccagtatctattttcaatctgtgtaggcagaatgaagaaagcataattgagcggtgctcatcttttaaaggcaaaatgaagttttcagtttggaattgattagttgttaggggattaagacctttgaggtaattccctgcagctggggcagttagacggcaggggatttgagtttccgccttgtaaacaaatctttaaagtggatttgctatttctgtggggaggggagcctctgtggaatttggtagttggcaagatttggcaattttctgcttgggaagaaaacaagatgggtctcaaatctaagtcctctttttctcagatcaacatcaccttttgaaaaataaattgattctttggccttaatgactactaaaggaaattaaaaacaaacaaacaaaacagaagaaaaatgattaaagaagccgggcgcagtggctcacgcctgtaatcccagcactttgggaggccgaggcgggcagatcacctgaggtcaggagtttgagatcagcctgaccaacatggtgaaacctcgtctctactaaaagtacaaaaattagttgggcatggtggcgcatgcctgtaatcccagctactcgggaggctgaggcaggagaattgcttgaacccggggggtggaagttgtggtgagccaagatcttgccattgcactccagcctgggcaacaagagtgaaactctgtctcaaaaacaaaaaaaaacaaaaaaaaaaaggaaaaatgattaaagtaagaatgaaaatttagttaatgttatttaggacagtaaaagcagatgtagtcacagaaagacaatgtgcagatgattatatggaaagaagaatgtgaaaccttcagatctctttaaaattttataatagctttgtattttcaaataaattgcaaagagtttctatacttgtatctagtttcccctattaacattgtacattagtgttgtgtagtgttttaattaatgaaacaatagtgataccattgattacgatttcatgaagtctgtagttcatttagagtcctttagtttttaagaagtgtcctttctctgttccaggatctcatccaggataccacattacatttagcagtcatgtctctttagtcgtctctttactgtgagtatttctcacacttctcttgtttttgatgattttgacagtttggatgagaattggttaggtattttgtaatctacacatcaactgaggcttgattgatgtttttctttaaaatatttttcccatttgtatacatgtgtggtatacaagtgcaattttgttacatgcatatattgcacagtggttaactcagggctttagggtatccatcacttaaatgatgtacagtgtacattgaagtaatttctcatttacccccccaaccccctcacccttgtgggtctccattgtctattatccactctacatccatgtctacacgttttataacacccacttatgagcaagaacatgcaatatttgactttttgtgcctggtgatgttttccttttgattaaactgggacacacatttatgggaggaagaccagacagataaagtggcattcttatcacatcatctcaagggcatacgccattgacatgacttattgctgttgatgttgaccatggacactgggctgaagtagtgtttttcaggtatgccactgtgaaattatattcccctgtttacaatactgtatactttagacataggttattatgtacaacccacacttaaaaagtggggagttatcttccacctccttgagggagtgaagtagtatctacataaattatttcatattcttatacaaagggtatttgtttatttcatttatttatatacttgtcttgatacaatgtaaatgaatcactacttatttatattattataaacatataaatatctatagtatagtttgggttacaatccaatacttattttgttactcacattgttcttgctttgaccactgggagatctttcagttggttcttgtaatacaccatttttaaaagcaaaatggagctaagtgtggtggcgcatgcctgtagtcctagatactagggaggctaaggtgagaggatcgcctgagcccagaaatttgagactgctttgagagctatgatcacatcactgcactccaatctgggtgatagagcaagaccctgccccagctaaaatgaaaacaaaaaacaataacaatgctacatgggaagtgagcatgacaatgtggtattttataattatatccaaagattagtaagcatgattcatggagaagtggctaaatctaagcattgttttcccatgagattgctgttggaaaagcaatagaaaaaaaaaaacaaaaaacaaagaattgagtgagtcaagagataggaagtctttcagttaccttagagtcacgttaggtatgtagagaagcagttcagattaacaaagttcaaaagatcccaccgtcagatctgtataacaagctttgcacacgaaagagctagagtatctgtgactctgatgtaagaaggtattaacccagtggaaaataaaaacaaaattaaaaatgcctaggtagactcatttatggttttatagtatccctactggggcacagatgggaagggagaaactgtttttaaataaaatgatcagaaacttagactgtgacattaatttgttggttcagtgttttaatttggaggtaaattatactaaacagtattatgacattttctgtagaaagtcttctacgtgtattgagtcactgcctgttatattggtttaatcagcaagtcatttttgctgaatctcttagtctccactaatattgtcttgaaggtgtaaatggcatgcaggttgcctaaataaagctacaacattctgtaaggcattttgtgaatgaactacttttgcagatggtacaggtgttcacccctgtaaactcacaattattttagaagtgatgtacaggttgtcagttgtccccatctgcctcattccccacatgcattgtcacctttgtgtcaatccagatctcattagctctttgtagacaaagatagaatggtagataatatataagtaaatgtggctgtgtttttgctcttcaagagaatgcacaagagactcactcttaattcttactatttcatgtatgtgcagcctcttaatgcttactatttcatgtgtgtgcagcttcttaatgcttactatttcatgtgtgtgcagcctctacaactacagtgcatctctattgtttgtacagtgacaataatggtaagaataataacttagtacataccatactgcagaaactgtttaaattacatccaatgtgcccatttaatcatcactttaaaatagtaactcctactcagtagcaatgtgcagtttatagatatctttcacatttgaagatatgaatctcagtgtacatatattggtatgcaaaaaaatcagttatatacatgtttagaccacttatattttaatcccaccaagcatatggaaagcttaaccttatgggtgtgtgtgtgtgtgggtgtgtgtgtgcaggggttctctaaacttaaaacctgttgtggatgcacatgaaattatatacagtgccaagaaggggcacaggccctgctcagtgagtcatctgactgcacgagttaatagatataacgtgaagggtcacagttctctatttgggtttttttgtacagcctctgtttctctgtctctacaaagcacgtagcctttttttcaagtctcgatgcctctttcacagctcagccctgggcctgctatcctgttttcactgcttcccttcttttttctacatgactttttattttactttaagttctgggatacatgtgcagaacatgcaggtttgttacataggtatacatgtgcaatggtgatttcctgcatccatcaacccatcatctatgttttaaggcccgcatgccttaggtatttgtcctaatgctctctctccccttgttccccaaccctccagcgggccccagtgtatgatgttcccctccctatatccatgtgctctcattgttcaaccaccacttatgagtgagaagatgcggtgtttggttttctattcttgtgttagtttgctgagaatgatggcttccagcttcatccatgtccctgaaaagggtatgaactcattctttttatggctgcttagtattccacctacatgcctatttctgagtcaagcacgttgtttatgcccagtgcattttctttatacacagaggctgagaaagaaccaggaagcctctgactgtttcaagtgtgttctctgctatatctatctactgattcaataagcacaagctcattgaatggaaaagggcaatatgcaaagggagcaaaatgagacatatatgtcaaaggaaagttccactgcaaatgtctttatttgatgtacacagagggatttgaattaggtctaggttttatgcccactttacagaaaaattgaaacttgatcaaacctatagaaccagtaaatgtcaggaccagacctggagacacactcccctcggtgcatattttatatcttcttcattttatcaccccaaatcatttactcctgaagtaaattcatttaatatttaacaaatgtttacaaaagttgactatagtaaaagtattatgttagctgctatgaagtagaaatataatcacacgattatcttaatgaagcatctctactttatagaagggaaattgagattctgaatcattaaggttttaagtgtcatcacagggattgttagtgatagaatacagagttgagtctagggcttattaaactgtatctgtcactctattcgtgtattagtctgttctcatgctgctaataaagacctacccaagaatgagtaatttataaaggaaagaggtttaatggactcatggttccacatggctggggaggcctcataatcatggcagaaggcaagggagaagcaaagtcacatcttacatggcagcaggcaagagagcacatgcaggggaactaccttttataaaaccatcagatcttgtgaggcttatccactatcacaagaaaagcataggaaaaacccaaccccatgattcaattacctctcactgggtccctcccacgacatgaaggaattatgggagctacaattcaagatgagatttgggtgaggacacagccaaaccatatcaattggcctatttcagtttgagaacatacatctgaatttcaaggaaatttgactacaattgaagaaattgagtatcattactgatttctaatggatgttgctgtatgtaatattttctatatgagagacaagatgtaaggatgaagatgagggacaagttcttcatctagaaagatcaagggtgctgtcaaggaagagttgaatttgattcagaactgaagaatatttgggctttcaactagctcagagaaattctgtagtcactagaagatccttgcatttgagagggcaaatttgaatatgttccacaagtaaaatcagaaattgggctttttattttactaaccagattaatgctctattccagaaatgcaaataggttgtacttttattttaacatggggctacttttgcctactgttttgctggtttttgttgttttattgcaaaaccacaattactgttacacaatggaagctccatcagtgaagatactttatctactttcttcactgttatattatggggtaaaaaagtgctttgcgtatgagaacaagtaataatgaaactggttacttttggcagagtctgcgttatacataggctcttttgtgaagatctaaatatggttatgtaatcagttgttcagacaagagaaacgtagattaattgaattagataatcccagtggtctctcaaagatcaaacaataaaacaaactattatcgtaccccatttgaagtacttttgtataacaacagcgttttaacatgtttatttggattaagattatcagcgactttggaagtcaattaagtgtgaaagcgaaacatggtatttgacgacagtaccagccctgtattgctgcaaatacattctataatagcactggacgcatcattcagattttatgacaagatgcaataaccagctacctgtgatgataaaatagacttttttcaaataagatttctagcaacctttactatgcatgttttctttgttgtcttgtaacattaaccatggacatcacatggcaagcatgatgaagagaatttctttagaatcgagttttataacaaagaatgtattccaaagtaaggatttatgttggtggataattatgagccaggccgactactatgaataacttacatcagggctagggttggagaaaatgaggagagagtagtacaattaaatgatcaatcataactagtctatttgtttatacaataatgaaaaatagtagtttctattggactgaaatgtttcaggtaaaattgatgttatatcaaattaattaaataataaatgtaattgccttaaatcaatgcatgcttaggattaatactgattaaaaatctaaggatgcaaaaagatttataacaaaatgacagtaacagtggtctttcctcaatctctttttctcccaaaagcaaaatctgtttataattttaatttttatgagagctacttatataaaaatgtagacaagaagaaattattttttctacttgtgcatctgaaagtatcttttcttttctttccttccttcctttcttccttccttccttcttctttccctccctccctcattcctttcttccttcccgcctttcttccttccttctttccctcttttctctttcacttccttcttctcttatcactcctcccaaatttaaaatcatctgtccattgtctttgtcatccagtatagataataaggaatctgatggtcttctcattaatagtgaacttgctgtttttctctcaaaaatgagaaagcttttgggagcttctttttatcttaagtgttctgaaatttcaagacagtatgcctgggttctttttaaattccttttgctggatactcaggtttcaaatcagaaggtttatgtccttcttcatttctgcaaaattatcttcaattatttcttgtactatctattcttcatctgtgttcttactgagataccgaatcatctgaatttgttccttttttgtatttttttctttcttcatattttataagaattattcagctttattttaaagtcctatttttattctctaagtgactattcttgtatttaactttttatagcatggtctacattttaatggttgtcatatatttttgaatgtttatttacagagcatcacttttaaaattgttttctttccataaattgggtctgtttgttttggaacaagcttttccatgtatttttctttttcactctctttagtgatctccagctgtcaattcatgttgtagaaggacagtgatgttggtcacagattccccaaatgctaaggttaggtgagaaccagcatactcatcaaagatcttcattttccccaaagacaaaatgcagtgcttttagaaaaaaattaattacttttgggatgttatttccctcatgataaacatggttgccatttacactctctactgctttgagagagaaatttctgtcaagctgtgaaattggtccacacacagcacttcaattaatttcagtttttgaccctcattgtcttctcaaaacgatcagcaccttctcaatctgaagtcacaggatggcagaggttctgcttagcagactctcccactttgaattgcagtgttttgttttacctctttcatctattttccaatttttagaaatttgttgactttttttgtaaactttttttgcatttgcacttctacatttatttatattattacttttacttctgtgggatctcagtaatgaaggaaacatatatgcctaggttaccatattgaattcaacatagagagtatgattttttaagtaaatcctgaaagaaaactttctataaatctacaaatcctcttgaaattttctttttatatttatttgcaaatttttaatttcttgtatttcgtaaactgagaattttagatacttttacatttgtagcatcaaaaataattttttaaaatgatgacatacttagagtcaatctattgggattgagtgtatttttaaaattagaattgttaaaatagtatttgacatttgctttgcttctggtactggtaggctagtttgctgcagaccaactttcacaccaaaaatctctagaaaaaaagacacaaacttcttatctcaaaatatccatgtttcagcagaggttagctgagttttgctgtattcagggtgtcattgggactgcgatctcgtctgaagcttgaggtcctctcctacacatgttcaggttatcgttccttgtggctacaggactgaccaaagttgtttcctttctggctcttggccggaggatatgtcaagcttctaaattatgctcacaatcccatgccaagtgtcctccatcataggacttctcacaacatagaagactgctttgtcttcaagacgagcagaagagcatctttctcacattaaatctgacttatcttgtccctaacctcttgacagcatttaataaaagctaaattcgttagatcagactcacactgacctaaacataagattaataaggatcagctttctattggttaatttaaagtcaagtgagtaagatgctaattacatctgtaaaccgctttgctatataaaataacaatcttggcagtaatatcccctcatattcacagtttcctcttacactcaaggggagatgattatgcagggtttatgcacatggaaccagacatcttgggagtcatcttagaattctgcctaccatgaagtctacataaccaaaaccaggagaaagaaaaagaaaaaaatatatagttcatgggaaatccagatattggggttatcttaagtaatttcgaaataaatatttaatatgttaagtattttaaatgttttaaatattcaaaaaattagatggccatggaaatgttcattagagaacagaaattaggattgctagacttaccaaataaacatatagagttccaagttaattttaaatatcaagtaaatagcaaatactttatacaatatatcgcatgaaatatttgggatatatttatactaaaagtttattgttactgaaattcaggttcaactgggtgccctttatttgacaacactaactgtaaactatcaaaataaataaaatttttgaaccttaaaatataacaaatacaattaaagactcaagaggttcaaagcacaacagactagatatgactagatataattgacaagaggatgagtaaagtgctaagtaggtcagagacaacatatactgaaaaacagagagaaaaaaatggaagattcagaaaagcataagaaacacatacgacatagtgaataaatgtcaaaaatatttattgtggttcagaacagaaaaagaatggagaaaaagtattatttaaagaaataatggctagggatattctaaaactgacaatagaaaacaagtaatagattcatgcaacactgcatttattaagaaggataaattcaaataagccatacctaccacatcatggaaaatagtaaaatgaaaaaaaaaatcctaaataagctagataagaaagtgtcatactacctttaaagttgcaacaatattataacacgtttaattgatttactataagaaacattggaaactagaagtcaaaaactgtgatccttgaatttttcttagggggcaggtaccatattgccaaactagaattttattcctggcaaaaacattctttaaaatgaaaagacaaataatggagaatgaacttgaaattgaacggtttagaattacaaagattttttcccctatttccaggtgagctcaacagccaattaagttttattataaaaaataaagcagcttatatctacttgaaaaagtgaaggcaaaattaaaatgttttcatttaaactaaaagtcataggatttatcactagcagaactacactaaagagctcttcagccatcatgagaatgttttgaaatataagcagaaaggaatgaaaaccagtgaaaaggatattatgtgggaacatctaaaagaatacttcccatacaaagcaacattattaattacatagtttcatgcacgtccgtgtgaagagaccaccaagcaggctttgtgtgagcaataaagctgtttatttcacctgggtgcaggtgggctgagtccgaaaagagagtcagcgaagagagataggggtggggccattttataagatttgggtaggcaaaggaaaattacagtcaaagaggggttgttctctggcaggcaggagtgggggtcataaggtgctcagtaggggagcttttgagccaggatgagccaggagaaggagtttcacaagacagtgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacattcctgtcttcttatattagtaagaaaaataaaatgaaatagtggtaaagtgttgggacagcgaaaattttgggggatggtatggagagataatgggcgatgcttctcagggccgcttccagcgggattggggctggcgtgggaacctagagtgggagacattaagctgaaggaagattttgtggtaaggggtgatattgtggggttgttagaagaaacatttgtcatttagaattattggtgttggcctggatacagttttgtatgaattgaaaaactaaatggaataagagaaggagaaaaacaggtataaaaggtctaagaattgggacgactcaggacatctgattagagagtccctaaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgactagttttttggggcacagtctaagttggtctggtgtctggaatgagactggggcctaataaaaaggagcgtctatacaggagctcaaatgggctgtactttgtagcattctgaggacaggtctgacttctgagaagggaaagtggtaaaagtattgtccagtcctttttaagttggtggctgagcttggtgaggtgtgttttaaaaagatctttagtctgttttacttttcctgaagactgaggactgtaagggatataaaggtttcactgaatactaagagcctgaaaaacttcttggctgatttgactaataaaggctggtctgttatcagactgtatagaggtgggaaggctaaactgaagaattatgtctgacagaagggaagaaatgactgcggtggccttctcagaccctgtaggaaaggcctttacctatccagcgaaagtgtctacctagaataagaggtattttagttatctgactcggggcatgttgagtaaagctaatttgccagtcctgggtgggggcaaatccttgagcttgatgtgtagggaatggagggggcctgaataatccctgaggagtagtagaatagcagatggaacactgagaagttatttctttgaggatagatttccacgatggaaaggaaatgagaggttctaagaggcgggctagtggcttgcactatagcatagcctgcctttgctgatgtgtggcgattaggcctggtggaactgccatcaataaatcaagcatgatcagggtgaggaacaggaaagaagaaaatatggggaaatgggataaatgtcaggtggatcagagagatacagtcatgggggtcaggtgtggtatcaggaataatgtgggaggccggactgaagtccgtgccgggaacaatggtaattgtgggacttaacaaagagtgagtacagctgaaggagccgggggagcagaaagtacatgcatcaggtatgaggaaggaaatagattttggaagttatgagaaatgtagagagtaagttgagcatagtttgtgattttgagggcctctaaaagtattagggcagcaggagccgctgcacggagacatgaggcctaggctaaaacagtaaggtcaagttgtttggacagaaaggctacagggtgaggtcctggctcttgtgtaagaattctgaccgcactaaccatgcctaggaaggaaaggagttgttgttttgtaagggattgaggtttgggagattaatcggacatgatcagcagggagagcacgtgtgtttttatgagaattatgctgagataggtaacagataaggaagaaatttgggcttgactgaagtaatgggggctgtctgtgaagctttgcggcagtacagcccaggtaatttgctgagcctgatgcgtgtcagggtcagtccaagtgaaagtgaagagaggctgggatgacgggtgcataggaatagtaaagaaagcacgtttgagatccagaacggaataatggattgtggagggaagtattgaggataggagagtatatgggtttggcaccacggggtggataggcaacacaatttggttgataaggcataaatcctgaactaacttgtaaggcttgtctggtttcaggacaggtaaaatgggggaattgtaaggagagtttataggctttaaaaggccatgctgtagcaggtgagtgatagcaggctttaatcctttcaaagcatgctgtgggatgggatattggcgttgagtggggtaagggtgattaggttttaatgagatggtaaggggtgcatgatccgtcgccaaggagggagtagaggtatcttatacttgtgggttaaggtggggggatacaagaggaggacgcaaaggaggctttgggttggggagaagggcggcaatgagatacagatgtagtccaggaacagtcatggaagcagataatttagttaaagtgtctcggcctaataagggaactgggcaggtggggataactaaaaaggagtgcttaaaagagtattgtctaagttgccactagagttggggagttttaagaggtttagaagcctggccgtcaatacccacaacagttatggaggcaagggaaacaggcccttgaaaagaaggtaatgtggagtgggcagcctccgtattgactaagaaggggacggacttatcctccactgtgagagttacccgaagctcggcgtccgtgatggtctatggggcttccgaggtgatcaggcagcatcagtcttcagccgctaagccgagaagatctgggaaggagtcagagagccttgggccagagttccaggggctctgggagtggctgccaggtgagttggacagtctgatttccagtgggttcctgcacagatgggacgcggcttatgaggaatcctgggctgcaggcattccttggcctggtggccagatttccggcacttgtagcaagctcctgtgggaggaggttctgggggaacgcctggctgctgtgattcaggcgtttggaagttcttgtgtgctggagatgtggctggggtttgtctcacagtggaggcaaggaattgcaacttttttctattattgtacaccttgaaggcgaggttaattaaatcccgttgtggggtttgggggccggaatttaatttttggagttttatttaatgtcgggagcagattgggtaataaaatgtactttgagaataagatggccttttgaccttttagggtctagggctgtaaagtgtctcagggttgctgccgaacgagccatgaactgggctgggtttttcatatttgatgaaagagactaaacgctcactgatttgggaaaggtctgataaagaaaaaggagcattaaccttgactatgcctttagcttcaccacctttttaagagtaaattgctgggcaggtgcgggagggctagacgtgcaatgaaactgtaagcaggacccggtgtgaggaggggaggtgataaaaggattatagggtggaggagccgaggctgaggaagaattgggacctagctcagcctggtgaggagcagcctggggaggaggggagaggtcagatgggtctgtagaaaaggaagattagaaagactcagtgacacttggggttgggactgaggggacaggcgggagggaaagaaggaagattgggggcgagttgcactgggtacagagactagggagggactgatgtgtaaaagaatgcctggacatcaggcacctcagaccgtttgcccattttacaacaagaattatttagatcttgcgggatggaaaaattgaaagtgccgttttctggctatttggaactactgtcaagtttgtattggggtcaactggcattgcagaggaaaataagatgcttagattttaggtcaggtgagagttgaagaggttttaagttcatgagaacacaggctaagggagaagaaggaggaatggaaggtggaagcttgcccatagtgaaagaggcaagcccagagaaaagagtagagacacggagaaggggtcgggggttcttgccctccagaaaagcagagaaggggttggggcacagagatattaggtcagggtgcagaaataagggatcagggtgcagagatataagaggtcggggtgcagaaataagggatcagggtgcagagatataagaggttggggtgtggaaataagggattggggcacagagatataagaggttggggttcctgcccctcctctagaaaagcgggacttgccgctaagagtgaaggagaaggggttggaggtttcttgccccccagaaaggcggtgaaggggtagagacatggagagaaggggttgaggtacttgcccctcccctagaaaagcgggacttgccgctaagggtgaaggaccaaggcaggtgtccctgtgtggtctgacacctctgaaatgtgggtgaataatcaggcatccctgcaatgattaaacaccaagggaaggctgccttcccagtctgtgacaggcaccggagttttgggtccatggataaaacgtgtctcctttgtctctaccagaaaatgaaaggaattgaaattaagagaagggagagattgaagtgtggcgccaagattgaaaggagaaagaggctgagggatagtgagggagattggagaagagagtaaaaagaggctgcttactagatttgaaattggtgagatgtttcttgggctgattggtctgaggacctgaggtcgtaggtggatctttctcacagagcaaagaacaggaggacaggggattgatctcccaagggaggtctcctgatctgagtcatggcaccaaatttcatgtgcatccatgtgaaaagaccaccaagcaggctttgtgtgagcaataaagctgtttatttcacctgggtgcaggtgggctgagtccaaaaagagagtcagtgaagagagataggggtggggccattttataagatttgggtaggtaaaggaaaattacagtcaaagaggggttgttctctggcagacaggagtgggggtcacaaggtgctcagtagggaaacttttgagccaggatgagccaggagaaggaatttcacaagacaatgtcatcagttaaggtaggaacaggccattttcacttcttttgtggtggaatgtcatcagttaaggcaggatctggccatctggatgtgtacatgcaggtcacaggggatatgatggcttagcttgggctcagaggcctgacacataggatttaaaatatggagagaataagaatacatggcaacaatagcataatagatggagtgaaattgagttaacatctaaatgccttgcatttttgcggaagctttaaactactatcttatattagaaatgaataaggatatatatcgtatgtttaaggaaattcaccatagaaaacaaaaaggatgtactatataatagtaaactaatgaagaatgtaataatgaactactctcaatataaaagaaataagtaggacaatataaaacagataggacaatttattttattttattttactctaagttctgggatatatgtgcagaatgtgcaggtttgttacataggtatacatgtgccatggtggtttgctgcacctataaacgtgtcatctacgttttaagccctgcatgcattaggtgtttgtcctaatgctctccctccaattgccccccaccccctaaaaggccctggtgtgtgatgttcccctccctgtgtccatgtgttctaattgttcaactcccacttatgagtgagaacatgcagtgttttgttttctgtgcctgtgttagtttgctgagaatgacggcatccagcttcatccatgtcctggcaaaggacatgaactcattcttttttatggctacatagtattccatggtgtatatgtgccacattgttctttattcagtctatcattgatgggcatttgggttggttcaagtgtttgctattgtaaatagtgttgcaataaacatacatgtgcatatgtctttatagtagaatgatttataatcctttggctatatacccagtaatgggattgctgggtcaaatggtatttctggttctggatccttgaggaatcaccacactgtcttccacaatggttgaactaatttacactcccaccaacagtgaaaaaacattcctatttctccacatcctctccagcatctgttgtttcctgactttttaatcaccatttaaactggtgtgagatggtatcccattgaggttttgatttgcatttctctaatgaccagtgatgatgagcttttattcatatgtttgttggctgcataaatgtcttcttttgagaaatgtctgttcatatccttggcccacttttggatgaggttgcttgatttttcttgtaaacttgtttaagttccttgtagattctggatattagacttttgtcagattggtggcttgcagaaattttctcccattctgttagttgcctgttcactctgatgatagtttcttttgctgtgcagaagctctttagtttgattagatcccatttgtcaattttggcttttgttgcaattgcttttggtgttttagtcatgaagtctttgctcatgcctatgcagataggacaaatttttaaaaaattcatagaatagtccatttaaactcaaatagttcagctattacattaagttaatatggacaaaatcctgcaattcgtaggcaaacaatttaaaattgaatactgaaacaaaatgtaactgtgttctgctgataagagatgtgtctttaatacaaaaataagaaagactgaaagtagaattacggaacatgataaacctaatcaaaacaaagcttgtaattctaaagaaactatactgaaaagcaagaaatatttatacataaagtttgaaattttataatgataaaaagataaaacaacagaaaaagatgacaaaaataactttgtaagcatttaataacctaatctcaaaatgaataaaacaaaaaagtacaaaataaataaacaatagaagaaaaataatgaatagctacatttacagtcatagttgaataatgcagtttttctcagtaactaaagaataagcaaaagatgattggataaattaaatatgttatatacatataatgaaatataattttgcaataaaaataaatgaagtattgatacatattacattaaacataaattcaacttgaaaactaagtgaaaatccagtcacaccctagacaaaaacttacaaaaagatattgtaaaattccatttttatataatgtatgtaataagtaagttcatggagttagaaagtattttggtgcttgcctgggactgatagatgaaggtgggggaataatgagaatgactgctgatgaggacaagtgtttccttttaaagtgatacaaatgttccagagtttgatgatggttgcacaaatgtgtgaatgcaataaaaaccactgaattatacactttatttgataaattataaattatttatccataaaactgcaaaaatgattttttaactaaaacttgcattcaatctcatccacctgtaaatggcattaaaattattttcagttcagtatattctagaccagtggttttcaaccaagcctaactttgtctcacaaggaacattcgtaatgtccgaagacatatttgattgtaacagtagaggtggagtgggtatttgcattaactaggtagaagccagaaatactagtaaaaatcttacagtaggtaagacagctttcaaccaaaacaatacaaaacaaaacatgtaactgccccaaaatatcaatagtgcaaaggttaacaagccctcttttagagacattgatctctattcctatataatttttaagcctcatggtaatagagtctatcttggaatgtgaatgaagcataatgtaaacattacaagcaacaacatgtcacatttttagaatttacatcattcagaataccccttagtatcacctgaccccaaagcttagaatgattttgccaattttgcaaatatgaaaacttagattatgttattctttttctaatgggccaagaaaggtataacactacactgtcactttttttttacttctatactaattactttctgaatatatatagatatctaatctatctatctatctattcttttaccacttaaaaatattattttaatctgtttaaaactaaggcctagcattaagagatatacctaatgctaaatgacaagttaatgggtgcagcacaccaacatggcacatgtatacatatgtaacaaacctgcacgttgtgcacatgtaccctaaaacttaaagtatcataataataaaattaaaaaaaaaactaaggcctaaaaataagaagtgctattttgtctgacagcaaaataaataagtagtttttaaaatagtaagctgaagtttaataattatgttaaaattatagtaacttttttctgcagtaattatttttgataaaaattaatgcaattacatgacataaaattaagatatagtttagtaagaaaaacacaaaacaataaccattgtagaatgaaaataagttttaatatatgaaagacttaagaatcctttaatacattaaactgactgatactagtgttctttgctgaatcataggtaacatatttattgatttttaaaatagggttagcgtagaataaatgaaatttataatttaatagtcatcaacttcacattcattttgcataccacaggagaaaaaaagaggctcagaaagattaagttctaaggataattgattttaaaattggggccagaattaggactcaaacgcatattttctgaggtctagccctttgtatattacacccttgctgaagactaaattcgagtgtgtgtcttattggcagtgagaaggcagatttgccaatatgtagtttctaaatcttgcatttatttctatacattttaaatttaatttagaaatagaacagggagagtaatgttagcaagatggtcaatcagagttgtttggcactcatccccacaaaaagggttgtggggttcccctccaacataacaaatgaacaactatatttcagtggaagttactgaggaagtatgctggggaacataaggggagtgaaaaaatccctgtgaagcacagaaactcaggatagaaccataaaagaagagggagacacacaaactctaccaaattgttccctcactgggattggctcatagccaggaggggctactgcttatcgagaaaaggtaagctggagacaccagttgtccccattactactgcagatgcctgcaggctgctacgggagggtcctgcaagcctcacagtcaacaaattctatctggggagctttctggagttcacatagctgtgttgccctatactaggagcccatttcgtatacccaccaactcccgtgacctaagttggaactgcatagtaccatcctgaaaccagactgactgctagagtatgtcctactctgggggccagtagccactgtgtctctccatccctgaggccccagcatcattccaccatgctcacaaggaaggccacagaactacaaccccagctactttaagcttaggcccagtggaatggcccaaatccatgcaacatcccctcctccctgggaaacaggcatatctgcacagcaagaaagccaacaagcagctgattggcctgtggtgcctgtgtgcctgacccaacaggaaggatggcagcagccccacccattgaagaacccacctcagagttggccagcccactatacctatgtaagccatgcctgacagccagactaggggtggccctgcagccctggaaagtccactacatagccagctggcccaccatgcaagtctgtctaaacagtgaggctggtagcgttgcccctaacaaaactgagccattacaatcacaaactcctgtagcctaggccactgatgaaattgcagacatcattgatgagaattatagctaatgaaactgcagagaaccacacagaaccaaagataatggatcatactcaactgacatcctagacacacctataggaaaaagtctctccttacaaaagttagcccgtaaagttggaaaagataactgttccaccagatatgcagatatcaatgcagagatataagaaacatgaaaaagtaaggaaacatgacatttccaaaggaaaataataattctacattaacagccccccataaaaaaatttatgcaattcctggaatttaaaataatgattctttttaaactatgagatataagagaatatggacaaacaattcaatgaaataagaaaaataatttattatctgaatgagaaattcaacagagggacagatataaaaaaagaacaaaacagatatcttggagctgaagaattcaatgaataaaagaagtacaactgagaggtttaacaacatactagccattttggcagcatatgtatttatgatttgtatagaagaaacagtttctaaatttgaagacagttcttttaaagtaacctaattagaggggagaaaaagtaaacaaaaataaaaagcaataaagaaagtctacttatgggacaccattaagtgaatgaatatttgcattataagaatgccagagggagaagatataaagaaaggcagaaatattgaaatagtatgtggaaacttcccagtcttagcaaacatatgaacaaccagatttagaaactctaagactcccaattagattacaacaaaaatgatctactccaaggtacattataatccatctatcaaaagtcaaagacaaggcaagaattctgaaaactgaaatggaatagtgtcaagtcacatataagagaattctattatactgtcagcagatcaatcattagaaaccttgcagcccagtagagaatggtatgacatattcaaagtgctgaaagaaaaaaaaaatactggcaaccaagaatactatatcagcgaagctgtccttcagcaatgaaggagaaataaaaaccttcccaaataagcaaaatctgagggaattcatcaccactacactagtctttacagaaatgcttaagatgatagtgctacaactgaaagtgaagataattactattatggaaacacatgaaaatataaaactcaccagtagagggcagctcataaccaaaatcagaatatcccagtgctataatagtgctatgtcaatcttttaatcttctgatataaagtttaaaaaccaaaggggtcaaaaaacaacttctacaattagtcattaagaaaaacaatagataaagacacacattaaggcaacaaatatataaattacagggaggggtcaggaaaaaatgtctagagtatttttatgtgaccaaaattaagttgctctcatcttagaatagtcgattataactacaagaacctttatgttagcttcatggtatccacaaagaaagaaattacaacaggtacacaaatgagaaagggaaaggaagcaaagcttagcacagcagaaaaccacccagccatagtagtaaataataaaagagaaaaaaagaacaaagagtctatacaacaatcagaaaacaattaacaaaatgtcaagggcaattcattgcctctcaataataaccttaaatgtaaatggattaaattcttcaatttaaagattgcattgttgaaaggattttgaaaaactaagaaccaactgtatattgcgtacaagacactcactattaaagataaacccagactgaaaatgagaggataaacaaagatactccatggaaaagaaaaccaaaagcaaaaggagtggccatatttatgttagataaagtacactttaagtcaaaaactgtaaaaagagacaaagaaggtcattatatttaataaagggagaaattcaacaaaaggatataccaatgataaatatatatgcacacaacaccagagtgtctaaatacataaagcaaatatcagatctaaagggagagatagactacaatgcaataatcacaggaaatttcaacttcccacttttaacaatagataggttgtctagatataaaatcagcaaagaaacatcaaacttaagctccaccatagtcaaaatgaatctaacatatacttacagaacattccctccaataattgcagaatataccttcttctcagttgcacatgaaacattctcaaggacacaaaacatgtttcaacatatttaaggtagagagtatatcaagtatcttttttgaacacaatggtataaagctagaaatgaacaacaagaaaattttagaaactttacaaatatgtggaaattaaacaaattgcttttatatcaccaatggatcaaggaataaattaaaaagaaatttaacaaattccttgagacaaatgagaatgaaagcacgtcgtttcaaatcctatgatatacaatgaaagcagttcaaacaaggtaagcttatagtaataaacacctatcacataaaaagaaaaagctttcaaataaacaacctaacgatgaacctcaaagaaataggaaagcaagaaaaaaatatataaattggtagaagggaaaaattaataaagcctaaaacataaataaatggacacaagaaaaacagttcaaaagatcattgaagagaattgttgattattttggaaaaaataaacaaaatttacaaaccttcagccagactaagaaaaaagagaaaactcaaattagtaaaatcagagataaaaaaagagacaatacaactgatactacagacatacaagagatcataaaagactattgtgaagaattttacaccaacaaatttggtaacctaaaaaagaaaagataaattactggacacatacaacctaccaaaattaagttgaaaatcataacagaccaataatgagcaagaaaattgaattagtaaaaagtcttccatcaaagaaaagcccaggatctggtggcttcactgatgaattctaccaaacattttaagaagactaataacaggtttttttgaactattttagaaaattaaagaggggagaatattttcaaattcattttacaaagccagcattacattgatgtaaaaacaagacaaagacacaagaaaaaaaataaataaactgcaggtcaatacacctaacaaacatagatgcaaaaattcttaacaaaatgatagcaaactaaattcaacagcacatcaaaaagatcattcactatgatcaagcgggattcatcctagggatggaaggatgttttaacataacatacacaaatcaataaatgtggcacaacacattaacagaaagaaagacaaaaacaatgtgatcatttcaatagacacagaaaatggatttgacaaaatttaacatccttttataataaaactctcaacaaattaggttcagaagcagtgtacctcgacccaataaaggccatacaaatgacagactcacagctaagatcacatttaatggggaaaacccaaaagattttcccttaagattagaaataagacaaggatgttcattttcactacttctattcaatatagtactggaagttctaactagagcaattagacaacagaaataaaataaataaataaataaatatagattagaaaggagaaaggcaaaatatctctctttttacaagtgacatgatgttacagaaggaaaacactaaagattataccagaaaactgttagaactaataaacaaatttagtaatattgcaggacagaaaatcaacatacaaaaattagttgtgattttatagacaaaggttaactatttgaaaaagaaatcaagaaaataatttcatttacaatagcaacagaacagaaagataccttggaataaaccagaggcttgataggtatttacactaaaaactatgaaacatcaatgaaagaaattgaagaggacataaagaaatgaaaagataaactctgtgttcatgggttgaaagaattaatattgtttaattggccatattacccaaaactgtctacagatttaatgcaatctatatcaaaataccaatgacatgcgtcacagaaataattttttaaaaatctctaaaacttatgtggaaccacaaaagacccaaaatgtccacagcaatcttaaacaaaaagaacaaagctagaggcatcacattacttgacttcaaaagacatcacctaactcccattacaatggctatgattaaaaagacaaaagaaaacaaggttggtgaggatgtggagaaaagagaactcttggtggtaatataaagtagtaaagcaattacaaaaaacaggatgcaggttcctaaaaaagttaaatgtgggaccatatgatccacaaattctactgaatatatacatacgaaggaaataaaatcaatatgtcagagacatctgcacttccatgtttattgcaacactatttataatagccaagacttggaatcaacctaaatgttcaacaaatagtaaatgtatacatatttacacaattgaatattattcagcaataaagaaatgaaactgtgtcatttcagaccaaatggttgaatacggaggactttaaatgtattcgtctgttcttaggctgttaataaagatatacccaagactgggtaatttataaaggaaaggggttttattgactcaccattcagcatggctggggaggcctcaagaaacttacaatcatggcagaaggggaagcaaacacgtccttcttcgcatggcaacagcaaggagaagaatgagtgcccagtgaagggagaagcccttcacaaaactatcagatcttgtaagaactaactcactatcaccagaaaggatgggggaaaccgcctcccatgattcagttatctccattggttcctcttacaacacagggtattatgggaactacaattcaagaagagatttgggtgaggacacagcctaaccatatgatatcatgttaagtgaaataaataagacacagaacgacaaacaccaaatgatctcattcagatgtagaatctaaataaatacgttgctcttacggaagtagatagtagaacactgttttaccagagatgatttggaaggggaaaatggagagaggtttgtcaatgggcacagagttacaattaaatagaagaaataagttctgttgttcgattgcatggtagggttactaaggttaacagtaagttgttgttaaatgaatttttgttgttgttttttttttttttttgagatggagctttactctgtcacccaggctgaagtgcagaggtgcaatctcagctcactgcaacctccgcctccccagtgcaagggattctcctgcctcagcctcctgagtagctgggactacaggtgcatgccacgacacccagctaatttttcatatatttagtagagatgggtttcaccatgttggccaggctggtttcgaactcctgacctcaggttgatccacccacctaggcctcccaaagtgctgggattacaggcgtaagccaccatgcctggacattaaatgaaatttaacctaaagctgcattcttacatattttaagttgagcctaagagtctcttcctacatagtgaactgtaacctaagtggatgtgtaaccagattataatttaaccttgtgccaatcactgggtttcagctaatcaaagcagccagttatccaaatcgtgttcaaataaggcaaacaccaagctgtaaccaatctcgctgtttctgtgtctcacttctgttttcagtacttcatttttctttttctgtccataaatcttctacgtggctgcactggagtcccctgagcctactctggctcagaaggctccctgctttgcaaatggttctttgctcaattaaactttattaaattgaatttgtctaagatttttcttttaacattacaaaacagctaggactgatgtctttgaacattctcatcacaaagaaatgataaatgcatgaggtaatgaatatgctaactaccctgatttgatatttatgcaatgtatacatgtattgaaaatcaaatggtaccccataaatatgtacaaatataatgtgtcaatttagaaaaaggaaaaaatagaacttgggaagaaatatatcttctaagaagatggcattttaggaaaacaatctctactaaacttattttcaaatgtttataaattgcataatttactttgaaagaggtatgaatgacttaaaattcagagtatcaagacttctaagttattaattgatatgtaaatacatatgctacattatgaaatataacatgttaataaatatatacctattgaaaaagtgtatacgtttatttctaagaaatataaactctagtacaattctattcctatttgaccagatgtctcctcacaacctaggtgtttgttttaatcatctctcttcctgctagactaacttgacatgtataaattctctactaatgcaattaaactgacctgcgtaagagacaaaatagccaatgacaaatctattactaagatcttgcattagtgtggtacatttgttacaattaaagaaccaatagtcacatattattttaactatagtccatggcttacattaattttcattccttttatcatacagttctatgggtgttgatatacaaactgcatatacctacagtttcatgaaaaatagcttcacctgtgattcacctatttatcctttctcttcctcctcacaagcctctggcaatgactgattttcttttttttttttttttacagtctctatagtttttctctttctaaaatcccatatggttaaactcatacagtatatagacttttcagatgggcttctttcacttagcaaaatgcatttgatgtttccctgtgtcttttcatggcttgatagttcattttgtcttcttgatatgccattacactaatatatcatagtttgtttatccatttgcttactgaagggcatcttggttgtttctaggttttggtgattataaacaaagccactgtaaacaggtttttgtgtggatgttagattttcacctcactcaagtaaatacctaaaagcataattgctaggtcatatggtaagaatacgttatgatttataaaaacctgccaaaccattttccacaatggttgtatcattttgtaatcttgtcagaagaaataagtgttcctgttgctgtgcctccttgtcgatatttggtgttggcaatgtgttgggatgtgatacatccattctaacaggtgcatatttcattgttgttttaatgggcagttcacatgtgtattttttttccttttctacagccgtattattccaacacttccacttgttgaatcgatggcctatgttgcttcattgggacggcagaaccaggtcttgaccataaagtaagtctttaattccaggcttttatatatgggagaagagtaattttttaaatccacaagaaatccttcacatattatgaatatatatggggcattatgtcaaaccacagtgtgaagggagaacatgccatctggagtgggggtttggaggcaccgggaaatgcctctgctttgaggagtcgtcgtccaggatttgagagagatttaaagtttattgttctagagaaggctttcattacccaagatttccccttccccaggctcttagccacagaagaaggggcgaggaggcagcaaggtgagtgagttgataggaaagggctgaaggaaaatgcttgaaaatactgtcagggctctggttgcttgagccttgcctcccactactccaccagcagagagcagcagaagagaagcaatggaatgggaagagctcctctataacttgtggaggggttcatttctcataggtgccatgggttctgcaaccagcaacacctgggaaagcagcatcttattctaagtcagagagaggctgagtccacttgccatgtccaagtggggcacctttgttctcactcgcagaaatatatagtatgagcctgtagtgccatagatggtagatgaagatggtctctacagacattggtcagtgttagctctcctcagcaggtatatggcagaaacagtcagcagacgtatggtggaaactcagaaaggacaggatcaatacacagaaggtagtggggaatgaagaatagggctgactggggacagtggttcatgcctgtaatcccagcactttgggacgccaaggcgggaggaatgcttgagcccaaaagtttgagaccaacttgggcgacatagtgagaccccttctctataaaaaacaaaaacaaacaaacaaaatagctgagggtggtggtgtgtgactgtggttccagctactcagtaggctgaggtgggagtatcacttaagcccaggaggccgaggctgcagtgagccgtgatcatgcctctatactccaaactggatggcagaattagtaagaccatgtctcagtaaaaaaaaaaaaaaagtaagaaaagaataaggctcagggcaaaagtaccatggcagaggctggtggtggacattaccaatgtgggagattaaagagtcccagaaagccagcagagtcagcaagattcaagatggaggcctagtcattgggccatctggctaagctccatgaacactattattgtctatccacacccttgcggatctcaggaacaatcaacacacgacagtagctacagacacatcagtccagacccagagagaacagaacttatgtccataactcaagtgacatatggtgttctccaatcagaggtcacagaagcaagccaaaatgaacatggaggttgatagagtttggatatttgtccccatccaaatctcatattgaaatatcatcttcaatattggagataaggcctggtggtaggtatttgagttatggaggtgaatccctcgtggcttggtgctgtcctcttaataatgagttcttgagagctctaggtgttgtaaagtgtggcacctcccctccgatctcactctgttcttactctcaccatgtgagaggcctgtccccccgaccttctgccatgattggaagcttcctgaggcctctgcagaagctgagtagatgccagtgccatgcttcctgtacagcatacagaactgtgaaccaattaaacgtcttttctttataaattaccccgtctcaggtatgttttatagcaatgcaagagcagcctaacacagagatccttgcttcttctatgagaatgagtaaacttaccttgaatacggtaacacccaggaaaagggcaaagaggaggtagaagggggagaaacctgaaataccaagcagttatccaaatgatgctgaggttacctgaaataaactgttttatactggaagcaacagaaatatcttgaagagatccattcaggatttttgtctttctccccaatactgagcaagaaaaaataatagcaaatacttaggcaacatttactatctaataggaactattctgcgtgtttcaaatatattaacctatttaatccttacaagaaccctgtgaaattattatacccatttcacaaatgagacccacagagattgagcaaattacacaaagttatccagctagtaagtttcagagccagaatttaattcaggctcttagccacaatgctatttttaagctttgtttctttttattttatttagaaacatggtctcactctgttgcccaggctgaagtgcattggtataatcatggctcactgcagcctcaaactcctgggctcaaacaatcctcctgcctcagtctcctgagtggctgaaactagaggtgtgagccactgagcccggccagccactatgctatgttgcctacctaaggcataataaacccagtgacggaaaataaagtttttgtggtcattgttttgttgttacacatatgaattgtagcaaatgcaccatgatccctactatagaaatgcaagagaataatttcaataacaacgataaagattggtgcgtagatgtactcaggttaatgggggcacaagaaagagggaaatggatttgtaaatacattcctgcagagggtaacacatgagctgggtctcagaaaaagagatctgtggttctgaaagttgactgtgtgctagaattaacaggaaggctttgctaaaacatgaaatactggggaccatccagagtttctgattctgagatctaagctagagccatatcacttgcatctctaacaggttcctaggtgctggtgacacagagggatcactcttcgaaccagagttagatggaaaagaacattgggaaagaaacactgggaaagaaagcaggttgagtggaggattaaatatgattagtttcatgcgcgtccgtgtgaagagaccaccaaacaggctttgtgtgagcaacatggctgtttatttcacctgggtgcaggtgggctgagtcggaaaagagagtcagcgaagggagataggggtggggcctttaataggatttgggaaggtaaaggaaaattacagtcaaaggggggttgttctctggcgggcaggtgtgggggtcacaaggtgttcagtaggggagcttttgagccaggatgagccaggagaaggaatttcacaagacaatgtcatcggttaaggcagggacaggccattttcacttcttttgtggtggaatgtcatcagttaaggcaggaactggccatctggatgtgtatgtgcaggtcacaggggatatgatggcttagcttgggctcagaggcctgacagtatgaagcaaggcaaaggagagagaaagcagaagttgggtaatgcttagtggtgtgaatttggagcagaaaaataacatgagccaatgtgtaacagaattccttggaaacctcaaaaattctgtttaaatgtgataattttaaagctaataaggcttaatgagaagaaaatagttctttgtgtataaacattttgagaaagagaatcaaaagacgctgaaatgcttcagtctgtgcacaaatatctgtgaatatctgtacctaacagaagttttatcttttgcctcttccctctctgctccatgcacaaacttactcatggtgacactccatccactgatgatgtctttttttgtcaaataaaatgttgaacattcttgaaaaaagcttgaagggactatcactgcccttctatatctagtgacgtctttttgttcaagaaggtaggttcactctgtgtaaagttttacctggacttgaatgtgagattgtaacactgccaacaaaagcaacattccatgtctcgaattgaaatgtaatctgtcaacccatttaaaacaaaaaaacaaaattacaacaaatttaggttagatatttaattggcttttatttacaattcatgaatgtgggcagcatctcattttataaaatagaataagaactccgatgagcttgttggatacagtgagttctaaacttctcttcaaagaatcagtatgtcagtatgttcagttctttgtcctccattttaaagtttaacttcctcgtagtttcagtaagcaacctttcccaccagttttaatcagtagttcacatctgttcccctggtcacctgctctgacctgagtcatcccagtcacctgctctgacctgagtcatcccagtcacctgctctgacctgagtcatcccagtcacctgctctgacctgagtcatcccagtcacctgctctgacctgagtcagttttagtcaccggttctgtcccaccaaactgctcaccccgccactctggctcatacccctgctctctttaaaatacccaatcagaattagcttagactgtgcagtccaaccctagccaacaggggaacgacacagcagtaggggcaataagaaccccttcccctccctcgttcaggtgtgctctcgccattgctccaaccatgagtcgcaccctactacagaagtaaaattaccctgctgagagaaaattatttgtttgagcactagttcgtcttttcggcatcgaagaacaagcatttgtttctaacaagctgagcagaggaggttggctttgtaggcagaaaagagttgaagaaaacagaacaaaaagcagattagtcatttcaaagttactatcgatatagagttaaaacagggaattccttattacactggttcagataaactgggctgcccctgattgtttcctgtgaataatgtgggttttttggtttgtttgtttttgtttttttaatactggcttgtttcaaagttcagtttgattatgtagcacctagcatgagtgaatccgttctggtttgttatagtctgttggggctgtgaaaggaaactgaatcttagggtccccaaatcactaagcaaaagggaaaagtcaagctgggaactgcttagggcaaacctgcctcccattctattcaaagtcatccctctactcactgagataaaagcatatctgattgtctgctttggaaaggctcatcagaaactcaaaagaatgcaatcatttgtctcttacctacctatgacctggaagcccctccccactttgttttcccacctttgcttctagttgtcccacctttcaggaccgaaccgatgttcatcttacatacgttggttgaagtttcatgtctccctaacatgtataaaaccaactgtgccccgaccaccttgggcacatgttgtcaggatctgctgaggctgtgtcatgggggcacatcctccaccttggcaaaataagctttctaaattaactgagacctatctcagatactcggagttcacagggccaagtataggcacttactctaaaacaaggatttcataaatttatttcgtacagcagtcattgacatttgttcagtttctatgtatgttcaggtgcatgcacattcatgcacacaacaaactgaattttactttttccctctgactctactgattgtgtaaataattgaattggtagacataactgatgttttgggttttttcttattgttttttttgtttgtttgttttgttttgagacagactctcactctgccagccagggtggagtgcagtggtgcaatctcgactcattgcaacctccgcctcctgggttcaagcaattctcctgtctcagcctcccgagtagctgggattacaggcaggcaccaccacacctggctaatttttgtattttcagtagagatggggtttcatcatgttggccaggctggtctcgaacccttgacctcaggtgatctgcccacctcagcctcccaaagtggtgggattacaggtgtcagccacagtcctggctctgatggtttcttttcccttgagttgttagagattcttcattgagagaactttgagcagacatgtaaagaataaagttttcttttccatctgtctttttctctctgttcccactttaatgtttcaaaattgttttacattaagctactcattgcatacataaaatgatttggattaatgtttgtgtgtgtgtgtgtgtgtgtgtgtgtgtgtatttaattgtggaatgactcaattggttcagcaaaacaatttcatttaacaaagaactaattttttcttcaaatatattatattctttttttcaatttttgtttttaagttccaaggtacatgtgcaggatgtgaaggtttgttataaaggtaaacgtgtgccatagtggtttgctgcacctattaacccatcacctaggtatgaagcccagcataacatagagctaatcttaaaccaaactgccttctaacattctatcccctatatttgtatctgaaaaggttccattatattctttagactcttccaacatttgcctgctagaaatgagaaggtttttataacatctgatcctatgtatttatcactcataaatcagaaactcaatttgaaccctgtgaagtatggaggtttaaagcaaacctttatttaacattttgtatgtcaacatttttccaaacttgacctgccaagtggatttaatagcagatgactctggaacctgaacaagtgtttgctcttatatttcaactattagtattgaattaaagactacaaggtttggatcacatggcagacttctttgatgccttatgctgctgatgctggccaagaagaggaacatctgagtatttacatgtttatgcctggggaattctaagaaatctttggacatttgacaaatatgtgcctataccactaagcctaagattgcatccaaatcatgtgcaaataatttctcatagatgggaaaaatatactgatgctaaaaagatgtcatatgagctgtttaaaaataacagtccaggaaattcactttttgtgaatctgaaattatctctcaattatctcaataattgtccaaagtataagatcatctggggaatgatgaaaccaatgagagactccgtttaacatttcttgtgcatttccgatgagtgcaaattataccacctttttaacacattactatctccttttgttctcaaagcaatccactaaaatgacggccagtgctacttccatctctaattttctctcccatcagcctactcatatgtatgcatttggtggtttacattcatcaaggttatggggctgcttgcccgtagcttattctacctgcaaaataaagtattacatatatatatatatatatatatatatatatatatatagttttctatttccagcaacagtgatttattttaaagtagtttgtcatcagtcttacccttggctatcatgatatacatttgattgttctctctacttgcaaacttgccctcccccaacatatacgaatttaggtttgtattgataaacattcaatggtttttttaatcaagcatagaaatgtagaatacatctgaactctttagcatggtctacacgcaggttgccaaatcaagcaaaatatatacataataaatatgtatgcataagtgttataaaatgttacattttctacatttataaagtatacatataaatatatacatttaattatctatacacacacacagagttgattatcattatttgcagcactcatattctataaagttactgacagcactgaatgaaggaacacagaatcactgcccctagaggaaatagttgttactgagaacctctacttaaaacattttcataaatcaatcaatacacaaccttgtgttatgcatgtttctgtttgaatacactttattttatacatagtgtatttaacactattatagtattaattcattaatggttgaactcacagccaacagtatcataactcattcctgaatgaaggttttctagcacacattattttcttcataagacgtagcaccgtcttcttgcatttagaaagaactgcatttaaaaagcacaatgcaaaaagcaaacataacaacaaatagattgtgaaaaagacacgtgtagtatgcgagttataatttaagatcgtgttatttatatgtgtttttttattttaagctgtctccccaaggtccatgcttatatccatcttgtgctaagcctgatataatatctgatacatgaaaccttttaaaatatttgatgaagaatgaatggtttaaagaattaacagaagtggtgtgaggatatatgaaacaagagaatccttagttatgtatctaaacctagttactcattatttcatttattggctcattctccacatagttagggagtaccttgtgcctaggcactattcaaggctctaaaaatgaagcaagtataagaagaccaaggctcctgtcctcatggagcttacactctgctggggcagacagaaagtagacagaaaattcagttataacttacatcatcgccatgaagaaaacaaatcaatgtgtggaaagccagtgcaataaataggacactgacatcttgacactcctccccccaccactgtttcacaatgtgcagagtaaattaaacacacacaaacacttccatatatattcagttaattttcaccactctgtatgcagagaacagtgtaaatgacataaacagtgatagagaaaagcaattaaattcaaaataatcagtatgttaataatgtaactttttcaaagggtttttgcaaagattttaatttatttatgaaacacaagtttattgaatacattttatgtcaggcattcttataggcacagaggcagaaaacttaagattgtatttcagggaagggaaacattctaaacaaattccaatcttcaggcatctgatttagagcagcgagaacatgatatatgaatgtgttagcactctatatcctcagcatgttaatcctcatgaaactaagcctttagtaaagctcgtgtattaaacatgcctgttcttttaaaacaaatggcaatcctcataaacagtgtgtccattaacaaaaatccacctattttgatttttaaactccataaagctcagagtgcaacctgctgctgaaagttgactttttctctgttgcttgggacatatggattttgacagtagagttgtagaaactgtttagctatttttaaaccatgagttgctcattctcatgttaacgcttgagtatttcttacaggctaggtagggaaacttgggtgagatgtttgtgattaaacacataattttgacaagttacctaaagctctccttatgtgtttgtgctatagtccacaggtataatgcctctcctacttaaccatgtgtgtattacatgtggtatatttttacatgtggtattattatatatggtatacattatataggtattatatgtggtatatattatataggtataattatatatacatatatatcatataggtataattattattatgtgaatcagaggatcacataaaataatcatgtcatcctctgctggaaacaatgcattgacttcccactgaatctagaataaaatgtaacctccttaccatttcctgcaatacttaaccttctaatagccttgatcacctttccagcttctctcctttacattgtcccacttattctttcctttctggtctcacttgacaactttcagtctttcaaacagactgaactctttctttgccactagttctctctgcctggagtatttttacttccacttttcacatacttggctgttttcattttccagatttctgcttaattttcacatcatcagaaagaactgcacttattatttaccactgcaaaggggccctactccgattcattgtctcatagcaccctgctcatcttatataatgtttatctgaattgttttgctatgtttagacatttacttattggaggtttctctacagccaaataggctctaaatcccgatgaggaaaggagcatcggtgctttattcaccactgtatgtctactacaagtacagggtggacacatgaggggtcttaaccattacttcagtataaatgaattaatatataatgtaagggtttaggatctttcactactagcttacttcaaggaaagatcagggacactgtgttgagaagaccttacattgttcttggtttagccattgtgtctcttttactttagccaagttgttccgcatttttagattttgattcttatttgtaaattataaataacagatataattaatataaacacactatataatgtaaaaacataaggtgctattataataatcaataatgtattttaaaagcagataattccatggatcctcacatttccttatagacttctagtttttcatcaataaagcacaaaagatatagagtaaatgcaagaaaataaaatctctgtgaccctttttgatttcctatttccaatcctctttttacccctagtttagcaatgtctttattgccattctttatttctccaatggtttatgtaatataaaattataataataaacttgataaatttagttaatgaggaaatttatggaatgagtaaaaaatacaagtaaggaagacaattttttttaccacttctgaagactgttgttagttaatagaacaatatagttgaccctgggcagtgaaattatattcattgtccaatcacaacatctgatcaatggctcattaatatctaatagtaattacttatattgcttcacagttttttttaatctaaaatataaagttcttattgagaaaagaaaaacagataagacattggtcttcataatttccaatgttctctgttatccagttatttattcagggagaaatcttaggaaaatctatgaaaaattagaggaatgatactctttctggagaattaatttacctgctactgcttcttcccactatcctattagaggcataattgacttagacacacgggatatgccaacctcattaaacctgagagcccataatgtgcagaatcacagatctaaatagcttcttttaagtttccttatgccacatatttgtatgccatagaatactgcctatggtgggacgtgcttcttgcaggatacttggaggccatctgtttattctggcatgagatcctctatgacatttgaagacttggtagcacttagtttttagtttacttcccattaataaaaaaataaataaaaataagtttgctttctatttgtatcacatacataatcaacatttccatgtgtaaaacagaaggtatgagcaaatctgaacataattgtttagaacttctcctgcagctccctgggggaattgtgtctcaaacgccatcagtataggttatcaacaagatgagaattgaaaagcccaattagagattagaatagggatagctgataagaaacatgaccaagcaccccaaattcagcttgggaagtcaaattaaagtacagagggtgaagtggtctgcatcagctgccaatgaggaatggcaatatttaaacaatataagcaaggaactcagaattcattggccaattggaggtcaaaagcccaggtttggaattaggataagattttgctgtgaaagtgagtgtctgattcatcttcattctagacagacagttccaacactttttaagtctcaaagtccctttctattgatgcaccccaattaactatgaggaatcactgctctgagatctaattaattctaatgttggtttcagggttcccttctgtaccagcagtagtagcacatggaattttgtgggattttgacaaggaaattacattactaacatatcttgaagggattcctataacagtttcttgataccataacaggttcaggtcactaagagtcctgccaaagtccaggcatggtggttcactcctgtaatcccagtactttgaaaggccaaggcaggtggatcatgaggtcaggagttcaagaccagcctgtccaacatggtgaaaccccgtctctacaaaagatacaaaaaactagccgagtgtggtggtgcacacctgtaatcccagctattcaggaggctgaggcaggagaatcgcttgaaccttgaaggcggaggttgcagcgagcccagatggcaccattgcactccagcctggatgatggggcaagactccatctcaaaaaaaaaaaaaaaaaaaaaaaaaaaaaaaagagttctgcaaagacttcagtttcttaaagaaaaagaagatgtgttaatttgtatgatttgcctatttttttctgttgtaaatactcacagcatggtcagtttcaagttatcaaaaagttaaaattcctgaattcttcacattggtgttctctaactgattcaaacaggctctggcccatcactgctggttatacaaaccttctagaatgaggaaggaaattaacttttccaagatctccagattatgagataaggtcaatctccttcttttgtgtactgaatttgaacccggtctttcttagttgggaaattcactcttacatgtgttatctttttattctgctatattggatcttctctctcagctgacacattttcaatagctaataaacagtttctgccatcagacattcttaataaaaagccataccttgaccccacacgtaatggcaacctaaattttctactctgcttcccagcaaaactttgtaaaataatttttttattgttctcatcacttctacttacattccacagggacttgactcttagccaccaataatctctagattgccaaattaaatagtgtcatttttacttctatctcaatcttttattagctttagacagggatcgctacacccttcttctgggagcttttttatcctcggtttcattgacactaaacaatgttggtttttttctttctaacctctccttcttgatctcagaattccaactcttgaaatgtttcaagacgttatccttgggtctcctttcctttttttgtctacacactcaggactggtgatttcattcaatacaaggtgttaaaaagtcccaaatctcaatctcaagcctgatttctcctcagaattccagaattatatatccaaatgtctattggatatttccatttgaatgtctgataaacatttcaaatttaacatgtcctgaacaacatttttgttctattccaggtgctggcaaactatagctgtgagtcaaatctgggtcacataattttgttcaataaaattttattggaactcaaccacaccaattgtttgcatttgtctatagcttatttcacactgccacagagacctctttagtctgcaaatactaaaacatttattatctggctctttatagaaagttggccaacagctgacctatataccaaatttgctcttcttgaagtacgtatttatctgagttgataacactaccttaagtttatatctcaagtcaaaattctcataattgtctttaatgttcatccttttcttgcctactacccccaacacatcagcagttcatatgggctttaccttgaaaataaaccctaaatctagttttaaaatgtccactgaaaccaccaatgttgcttgaagcattgaaacaacttcctaatgatttccttgccaatttttttttacccttttacaactttatagtcttcttaagttatagaaaattcttcttaaatcacatatcagatcatcttttccttgcttaaaatcatccaatgggtatgtatttctcttagaattttctcaactccctaccttctcttacaaagttctgcataatctggattcttactcctccgcctaccagttctcttctcgctcttggcccactgaactgcagctgcactgagctttctcttactccaacatgctaatttttcagttctggccctttgagctagctgggttctctgcctggaattctctcatgaacgcctttcatgaatgtctccttctcatcaatcaggtttcagttcaaatgtcacttctttcaagaagcttcttcttaataattcattctaacagagtcgtacaagtatatatcatattatcacttacctagtttttaatgttcttcaaagcattttaactataagataggtcttctatttacttatttttgtatttatttgtttgctggtgatttttctgcctcttcaaaatagaatataaattctccaagaataggaatcatttctgtcttgttcattgaagcatccatagtatttaggacaatggtgaacaatattggttgaatggatgaatactcagctattatattccagagaggtttctcaaggtggtcttgaagaatgtgggccaggttaattttcttagactaattatgaaggcagaaggaagagcaatctattctattaatttaagtaatgtaagtatccctataaaagaattaatttatttttattgtatttttcttaaatataaataagtgtaacattagttataaactcttatatttgctacttttatgcactaaaaccaaaacaattaccataaattaatcaaattaagatgtttacttatgcaattattttattagttgccctgataaactctttgagggctggatccatgtacgaatgtgctcactaatgcgtcatctgtggttgaaaacattggctgggacatagagtttggcaaatacttgtggtaaattagtgctgaatagtaaataaatacatggcctctgcaatcaaggtatgtgtgtctagtaggataggcttaaagacacaaaccagttgaccatccatctgctagaaaattcctcagaacaactctgagcttcaatattaattgtgggcatttatcggcactaactatggtacactcttaaagaaataacaataactgaacccttataacaagctttgaaagcatttatactctgattatttccttattacaagatgaaggtgagaagaaactgggaggttgtctggccacagttaataagtagtagagccaggatttacagccagtgggtctgtatatagagcctgagttccattgattcccagctaatgagggagtaaatgattctttttcattggcaatgacccagatcccagaatcacaagttatatcccactagagcagactggattttactcattaaggttgcatttttaacaagataattcattcctactgctcgatacagtagctatagacagttacttttatctaaattactcaccaaaatttgaaggtagaaggaatttagaaatactcttgtcccacctcttcatttttcaactgaggaatccagagttctagggagattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacttttggaatcattgccagaatgtggtagtctgctcatcaactgttggaaatataatccttctgtatctttcagatgatcgggaatccttttcatttatgcatgcatacttacactcacctttccattcctttatttacttattcatcaagcatttcttgcatggcaattatgtgcagagctttgtacttggtaaaggggaaaataaagaatagttgaacatgattttattcaaattgattctatcctctattacattttattttttaatttgcctgaagtcccttcaaaggtagacaggttgtaatttctcaataaaatagatatgaaaaaccaacaaaatcttctagcatcaatgtggcaattagctgctgactgcaacatgtattttcttaaagttgctatgtttctgcttctatcaatattaatagctaatattattgagtgtttaatatgtgccaagcactctgttaaacactccatgtatgttaactcatttaatctcctcagcagttccacaaggacatatagttattatatgtatttatagcataaggttacactcctattaagtggtaggaaatccaaactttctttctccagggagtatatgcttaattgctttatcaaatttgtaaattgataaatttgtaaattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacaaacaattgtttgtaaattgttagcttctatagaaaatatccaagaatttcagtagaggagtgttcaggagcctgtgagttatcccacattgaaactaggagacacactgctcttcattttctccaacaaatacacctcactttctcttgtatgatttttcacagaattcctgccctattagtaacatagctgtgattttatttaatccaaatactgataagcaattgtgaaaaatgtgaatatctgagaacctgtactttgcaaaatacatttttacttaaatatgattctcttttagaaaatgctgttgcaaagtggtgcttatttgggctctgtatttttttggggggagcgtcccgatttataagggcaataacaactcaaaaaatggtatgagtaaaaatggctgttctcctgagcttggtagaagattggagaaagcataaatagcaatctactcccctgatttattctgagtactcacacaactgaggcccaaataaattataaagtgtttggctccagtggtgttattaaattccttgtaggctggaagcattgatcatttgatacccttaggtttgcgtttcattcaaatggtggaaagatatatactaatactatatatcatttcaacttcatgcatgagacttgaagcaagaaacttctgttatagctagcaggaatagtctgtgaggtgaattggatgtacactgcacatcaaagtattgataaattgacctacatttttaaagccgaaatgtaaacctcattgtgcatcaggaggtcgacactgtcagttacctagatatttctcagtgttaagtagttatattatgaaagatgaatgattctgtacaaccctgtataaatgtgactgcatttggactttctaaaagaatataagcatgtatgcttggaaatcctctacctatttggaaatagaacacactttgcagttgatggtagaaattatagatttcttctagagaaacatagaagttacagggatttggctgatgacaaagacatattcccacagcaccactaaatgctttctaaatacttgttatacttaaatacagtattccatataatatgggagaaacagtttgatgccattttagttacattgtgtatttagcatgaactccaaaaggaaactcagctaaactccataatctctccacttactggttcaagagtcagagttgaggagactcatgtggaattcttgacctcatttacattcttgtgtttcataacttctggccctcggtttcttatttgcatagacatttagtgtctagtaatcaacgtgttgtagattctataatgaccgtataattagcatcttctgtgcattatttctgatcccctacagagctcactttgaacatgagacataagactctgggagcactgtagggtaaattttgaaacagctattcattctggctcctatatttattgtttctgttttaaacttaatttcctattagttgttaaagtgttcacttatttttcaaagctctttgaaattacaaaaatgggtagctattctctaaatcttgcctgattttttttccctaaatggaaagtagtatagatttggaatccactaaataatacttaatttattcctttatctgggtggagaattaaatgtcacaattagtcattatttatatttattgtattctagagcaatgttttcttaaatacctcagttaccttcagataaagtcctttctaagagatacacattaactccttcaaaatcagggatatcatttcatagctgccttaagggcacctctgaaacatctaatgtgtttgcaaagattgatttagatgaagcatgaatactcccataaaatactaatattgactaattattccttgcttagaaatcatacatttaccattttatacccttgctcccttcactgctagaggtattgccatagatggtagaataagttaaatcagaatgtgtttccactttcaaatttcatcatctatcatataaagtacttgttttttgtcatattttgctatgaaattattaatgctggtgggcatgaataaaatatgtcatttgtatctgaactagtaatatgaatcttagagaaatgatgagttgctgaaaagataattggaacgagtggaataacttaatttatcatattatgaaatttatttctgggcttttaatctttattcgtatacgttggctccagatataatgacatatccatccctaccattacaaattattacttctttcaagagaatatattttcatgtgacttttgttttataactaaagggaaaatgaaaatacgtatatataaaacatcagttcagaaacattccccatgctatataattaattctaagtgatatatgcacagaaaacggagaccatatgtggtagagaggaatctgacgaagtcccccaaatactcctgttttctggttattcaaacaaacactaatctagatgtctgtgtaaagaaatattacagatggaattagaatcactgatcggctgactttaacttaggggaattatttagcattatccatgtgagtccagtgtaatcacatgggtccttaaacgcagaaaccaacgcagaatatttagtcagtagagatgcattggagatacgaggcaaaaagagaaaagtcagaggattcaaagtcccattatttctggctttgagggtgatgggaattagcctagatttatcgcctctcagagccagtagtgaaatgaaggccttaatcctatgactgtatagcacttatggaaccaaccacaccacactgtacctagacttgggacccttgtgaaattatacatttgtgtggttttgagctgctaactttgtggtaatttgttaccataacaaagagaaaataatattccatatttacttgccataaccaatgcttaagcaggcaaaccttactttttaaaccatgctttagagaagttatgccagtttgcctcattaacagcctcctttttagtaacattccggataatgagtgggctcatggaaatgataagaatttcaaggggaccccaagtggtcatatttattttgctattgagttcaagtattttcaatattgttaacacaaatgctgcatccagattggacttttcataattcacacctcacaatgtcacttccccatcatatcttttgcttaaacgctttcaacgacttttgacctaaggaaaattgggcatttttaaaaagtccatgcctgatttcacctttatctgtgtctccagtgccgtacttcattcctctatgattccttgcttggaatattgtctttatatcttcaccactttacccacttgatacctagaagcactgtggtataatggttaatagggtggactctggggttattctgtcctaatttcaaatcctggccttaccacttccttgctctacaacattaggcatgatactttacttctctgtgcctcaatttatttatcaataaaaccgggaaaaataataatacctactttagcaagttgtcatatgcagaatttactcatttgtgtctcctccattttttgtgtactttcatttttttctcttacacatttaatgaatatttatttctataaataagtgtctatgatcctagacataatcaggagatgcaggtataaatttgatatttttctcctcataggaccaagtaactattcccatagctgcaaacatagattacttataactatttttttcattcactgaaaaaacatttattatgtacctactgaatttcagaaactaaggatacatatatgaataaaatatagttacttatctattctattgttaactatatgtttgatggaatatagcaaaaaatgtagtaaatctggtcaaattgtcatttattgataaactagaaatatttcagccagtagagttaggtggatataactagaatttaagcaaacttttgcactggaagaatcttttatttttacaaacttgttctattgagtgtttgtaatatgtgaagcacattatagaattataagaaaaaatgcatgtgaagcacctaggataatgcctggcatataatgagtgtttattttaaaaaatatatattgtttgagcccctacaaagtgctaatcattttctaagaaacaaggacatatcaggaatgtgataagattctgttccaatggaagaaaaacttgttgagcaaataaaatgtgcatagcttaatagcaaccagcatggtttaaaacacatggatagcctgagctacttttgatatggcatcagggatgatttgggagaggtgacaattgatctatctcctggggcccagagattgaaaaaaaacaaaaacaaaaaacaattgcttgcaacttaatccttagtgtcgtgcccctttttgttcaaaaaaacccctttcccttttgtaattcattgtaggtttttcttctcaattaaagttatgtcagaaaactaggcttaataatttagcttagtattccatatgccaaactgattagttcatattatatattgtcatggttaatactgagtgtcaacttgattggattgaaggatacaaagtattgatttgggtgtgtctgtgaaggtgtagccaaaggagattaacatttgagtcactgggtcgggaaaggcagacccacccttaatctggtgggcaccatctcatcagctgccagcgcagctagaacataaagcaggcagaaaaacatgaaaaggcgagaccggcctagcctgtcagcctacatctttctcctgtgctggatgcttcctgccctcaaacatcggactccaaggtccttagttttgagacttggactggctctccttgctcctcaagcttgcagacagtctattgtgggaccttgtgattgtgtaagttaatacttaataaactcccatatatagatatagatatatatctcctgttagttctgtccctctagggaaccctgactaatgcatatatgtttatgttatttgttctcatgtccaccaaaaaggtcaattaaaaaaaccttcccttagctgtggtaataccacacacacacgcacacacacacacacaaaaccttcccttagctttggtaatatcacacacacatgcacacacacacacaaggcatgcacaagcgtgcacgtgaacacacttaatatgtactttttaaatcctcttttacattaatggcctatttattttaaaacttgagctaattttcagaaaatcaaattttgcaagtgttgctttgtgtgtttaattgtatcaattaattactgtatttgcaaggtttaacagcccaaaagctatcaaagaaagaatcattttaagagcttcaagttgctgacacttctaaggcaaaactggaaaagacacaagctgaagaatgattgatttcttagggatatctttctgtcataaacccaagatatttgagaaaggcatgctagattttattcactgcatagtgcactgccaatatcaacattttaaaagcttgaagatatgaaaagtagaattgtgtatcaacagtaaaactttacaaacatcctacaacttatattttaaatacaataacttttaaaggtcctagcggtcagtgggaattgagagttattttattcggtggttcagaccctgtgtttatgcagaaacgatcttctagtaattttaactgtagtgagctttctaatgaaggctgtgcaaatattaaacagctactacaattatgcttcggttttcttttcaatattgaatgtttacattcttaaagcatctctgatcgatagcttttattgactgtgttttctccttcctcagctatttctttacttgttttgctttattcatttcttcatatggtatgttatttatttatttcatgttgatgtgggaaaaaagttgccctctttttattaacagattgaattatcagcaggcactgaggcttagtgccaagcaagaaagacacagacaagcttattttttctgctaccactttgaaccttgaatacagacctctgggtaatgtcacactggatacttgctgaatatttgctgaggacttcttttatgtttgtctcagcattggtttaaaacaagatcagggctaagaagagccaagctgctcttgcaaaggtcttccttcatttgccttttctctcccagactttccagcaactcctgctctcctgcatattgatctgtgacttgactctggacttcatgtgttcatgtgtttatatgttaactacttggtgatttcaatattttttacatgatgcatgaactcagcatgaccaattcaaacctataatctctcgacacaagtcttcaaacctggtctacttcagtgtaatcttatcaatgaatggagaaacatgactgtccagctcttacacaagccagaaacccaggagtcactttttgaacaactccctccctctctcattgttcgtattcattcctaaatattctatgattacccacttctccccacctccatggccatcagcactactcaaaactaaatagtcactatctgttttctggagacgggagtgtcctaactggttaatcctagaaacttttgtgtctctttacatggttttcacactggatttatctaaatagatatgaaatgatatcatgtgctccatctcatatatgaaacacttcaatggattctcattacaatcaatgtgacttataaactctacaatgtcttagctcctttttacagattctgcccaaaccacattggaccatgtcaattttattataagacttcaccatatgctatttcttttacctagaacaccatcgttcattcataccctcaaacacacgagcacacacacacacaatcatctttcgcaaagttaatttttttcttattcattcatttgtttcagaatcccattcaatgtgttcttccatgggaaaccctttttgacctctctaactagaccaatttcttttcttcaaagcacttatcacagttgtaacttcacatttatttctagaatttattagattctgagctgaaatttccatgaagggaggtaccatatttgcttttgctcaatatctgatccatgccatccagtttatcatctgacacataatatgtatttgataaatgtttttggagtgaactgcctttagttcatgtgaaagaaatgtaattcatttttggcctaatagttcttcaggcaatcccgagaagcatcatacttcccactctgacttggactttctcacttcagaaataaaatgacctgaatttatttaaccattttcatgttaaatatttagtgaccctttgtcatcctgattgtcttgccctgcacatgtttttcatattctatataaaatatagaaaactctgaaaattgggtgcctagaaatgaacccaattctctaagtaacaagcctttctttttttaccctccatacatcactgaagtccatgttcattcaattttgtagatggtagattagctaataaaatagccataaacatttctattataaggctaggcaccctaatctgttttatcagggaatttatttacctttttctgacataactcccagtttgttttagtttacacagtagttctgtcttacccacttgagtcaattatgactaaacttagaatcatgaaccccaccacagaatatctcattactgggttcttttattttgatttttttcttgttcttgagatgaggaaaggaagttaaaagaaaccaacattatttctctaaaacttccacaaagatcaaagttgaaactggaacatagctttcctgatttatagaccagaattctgaaaattacaccaaaggtggctaataattagaataaatcatatctgtaagaggctttaaaaaataagtattctgtttttcacattattttttcctattttatgcccattatccaagatgttgtttcaccttatctgagttagaaactagcaatcagtagcaaaaaaaaaaagaaaaaaaaatcctaaactaactttttaaaccttacaatgtatagacttgttgtactatgcaacttatatcatgttaagatattaaatgaacaataataaaatataagagttgaaagtcaatttactcaatcattacataaaaaatgaaatacttctaaatttttaaaacccttagattttatgtagctatgaacatttagaaaaactatgctatgcttttaactgggatccctctatattggtacccctttcaaattccttttttttttttaatagaaggactcaaaccacccctttctatttctaagcctcccagcagcaattgtgagaatgtatgccacaccacccatatgttcgtctccagatggctagcctgcttctctcagctcccccacctgcctgggccaaaggcatgctgtgcccagaaccctgtgtataacatgaaagatgctgatgcctgctgtcatccatacccttgcatgtccacagtttaatccgagcacaagcaaggaaagaaagagaggcaaagctggaaggaagcagaattagagttaaaggagagggaggatggaggaagaaaagaggagggaaaaaagagagtaagaaaggatgcaaggaggaaaaggttacagtgtgatgagaaaagtatagttattttatgagagtcaatcattattttggtaagattaagaaaattgatattgcacactcaaaaatcaaataaatagacttaaatttagtcacatgaagacaagcacaaatggtttctttgtgtaacattagaattgatgctgtgttgtactggctctgaaagtggatggtaagctgcaagtggttgttcgtctgctattctctatgaaagacacaggtaccatcctatggatttgagagaagtgtttcacatctaatgttactgagcaataacacccaagattaaaaacataacagaaaacacatacatgttgctgatgcatatgggcatcacgtgtgtgagttgcaactcaagcagaaaccctcagataaaggagggcggtcaaaaaagttataaaggagattttccttctttctaatgtttcttccctgcccttagcccagtgtatcttcaagtatgaccctgaggtaacccactttagagtcaccttgagtagtcaaggagacccatagcataaataattaatcagccaacaaggatctattgagtgatatctcaatactaagcaggtaatttgttcattcaacaatatttattgagaatcaattatgggtcacatactaagttcagcactgggatatattattttgaaaaaacatagttctggctcttttattcaactaatattctttgaaaacctactgtaatctaagcactgttttaagctttaggaataaagcattgcaaagaaataaaaataaaaatcattccttatgatgtggaggttcttgttattgaaaaccataataaataaataaatgagtcatttgtatgaatacattatgcaaaaagacaaaatgtgctggagagaaaatagagcagagaagggagtatcaggagcaagaggtatgcaatgttaaatagagtggctaataaagccttttctgagatgcttaaacttgaggaaaaacttgaagatggtgagggagtgagccatgtagctatctggcagatacctggaagaaatagccagtgagaaaggctctggttcaggatggtgtctgtgactgaagagtgagtggaacaagagagagagtggtagcagatgagaccagagagtggcaggatacctttacaatggcctgcaagacaccacaaaatctggtatcttgtaggccattataaagtctttgtcataacttgtctaaatcaatttgtattgagggatccacccccatgacacaaacacctcccatcaagcctcacctccaaccttgggaatcaaatttcaacatgaggtttggaggagacaaatatctaaaccattgcataagccctccccgaatccctcccttctttagagtgaaagccaaattctgctatatagaaaaagcctgaacaggactaaattggaagaagggaaagcaggtgggaggcaattgcagtaatccagtgagagaggatgaaagtgatggaagtgacagagttgaaaagatgtaggtacattctagatatattttgacgactggatttatagaatttcctgataaatcagtcttagaatgagagagcaagagataagtcaagttcgactcaaatctatttggccagagtagctggaaggatggaactgccattaattgacatggaagtgtggatggagaaggatttcacggaggaatgttaattattgattctgtttcaacaggttgattttgagatcctagtggagattttcattagtctagagttgagaggaatagtctgaggtagagttgccataggtgatattttaaaaaattagattggcaaagatcccaaaggtacttagcgtcatatcaagaaatgaggaattacaaagaatgtgcaatagggtactccatattagaaggtcaagaagcagagattattccaccataacagactgagaaagattagacattcatcgaagaataaaaaatatatggtgtcctggatgacaagttaaaaaattatttcagagttgaggacatgaaaaacaaggtcagaggctagagaagtaagaatgcaattattcgatcattaatagaagaaacaaaaggttaataaaataataggtaagtcagatactgttaataatacgaattaatataaaatataaaactaaatgctacaaaaagtacatcattttataataataaataacaacaaatataaggatagtggcggaaaacatgggatgaggaaatgcttgtttaaagaagtaatcttgagattaaagataaaagatatgtacaactcactgaaagtgaaactgtgaaggttttggagtgttacagccagatcagatgacatttgcaatggccttttttggaagaaaacatagtgtattcaaggaaaaggaaaaggctagtttagttttagcattaaaaaaatgaatgtaccaacttaaataaggaattatgtatgtttggaaagaaaagtcttgaaaatcatgggcaacataaaccaagatgagaattaaatgacattatgttagttaggatgttttgggcaacaaaaaagaaaatatcggcataaaaattacttacaaaataatagtttatccataagtctcaaaagagacatatggaaccccacaattctatatctcaaaagagacatatggaaccctacaattctatatctcaaaagagacatatggaaccccacaattctatatctcaaaagcgacatatggaaccccacaattctatatctcaaaagagacatatggaaccccacaattctatttctggacatctatctaaaaggactgaagggtgtgccttgaggagatatctgtacaaccatgtttatagcaacatggttattacaataacataaaggtggaagcaacccatgtgtccatcaatggatacatgaataaacaaaacataatatatataaacatggaatgtttgttattcagccttaaaaaggaaggaatttctgacacatgttaaaacacggatgaaccttgaggatattaaacttagtgaaaaagccagtcatagaaaacaaataccatattattccacttatgagagagagtagtcaaatttatggaaacaggaagtagaatggttgctcccaggggcttaagttagagagaaacagtgagttactacttaatgggttcagagcttcagtttcgcaagatgaaaattgttctagaggtagatgggtgtagtgtagtgtacatatgagtgtacttaatgcctccaaactctacatttaaaataggctggtaaatgttatgttacatgtatttcatcaaaattactactaataataatgaaaggggtcactggacccaatgaaaaagaagaaagaagaggaggaagaggtgaaggagggcagagagatgtaacaccagggatgattttagtaaattcatgatacctgggctccaggtaacttctgcatgactcttttagtcttcccttcgtggtcacaagatagctattgaaactgagcatcaagtttttccacaaaaatgtctaaggcaggaaagaagaatcagggacttttttctcatacaaccctttctttctaccaattaatagaatatgtttctcagaggccttcaaccaagatcactttagtgtaattggccagaaccataataaaattgccatacttgtctgcaagaaaaattgtgaaagaaggtttctaatgatttcagattcactttcgagggcaaaagtcagtggtgtgctgatagatatttaacaaatcactatctgggacgggagagaatgtgtgtacatatataagtgtattatacattttattgatataaaagatttgtgggacactataaataataatagtaatatataaagtattctttattgtcaattttgtatagccaaatgatctacacagtgtgcgtgcttccattgattttttttccatgcttttttatccatagccaaaatatagttgcaattcacaagtgtagttccaacaagaatggtgatagatattttcctcgtagttaatgagtgatacgcagtgaaccaatgaacacatatataaaaacttagtgtgagtaagctttttcccaaatcttctgaataccagaatatttcctcaatttttttgcactatttacaatgtaacagctattgatatgatatacttttaactttaatctctattactaatgttttctccaacacgcttaagtctaaacaagcgacaggagagtgccaagactggctgactagaagcagctgatgtgcaccactctcatgcagaggagaaagagtagcaagtaaaggctggcccttcagctggatatgcaggtagacatgctgggattcatcaaagaagcaatatgacctacacaggtcagagaggagcaacataggacagttgcccacccaggattggcatggagcaaggggaggctttccactataggaaattgtgagtaatagcccccgaaagcccactaccaattggagggccccccggcataggctgatcactttcattggtagtggctctgcatttctctgggagagagcccaattaaaaggacctctgcctcttaccgctgctaaggacctgctgaggaaggaacataaggcccgagcttaccccagggctgctatgtgcagccaaggaggaccaagccaagatctgcatccagcactcaagtgagatagaagcctacacttcctgagcactgagagggtatcatggctgcaattgtgaggaaatacaaagaagtcatgttgctgagcgtgagcctacaacatggccattacacctaagcaccatctactagatcacagcccaaacttcaacaccaaaaatacttttccaatatacccccaatccactgcaatccctgtcctgtgaaaccaaggacaagaattcagctacaaatggagacgctgcacaaagcctcgtccctcgggaaacatccagaaatgaagtcaactgacttcaacacaaattccaacacaattgaaggaacatcagcccacacagatgagaaagagccagagaaagaattctggcaactcatatagccagagtggcttatttccttcaaacaactgcactagttacccagcaaaagttctcaatcaggctgaaatggctgaaatgacagacatagaattcagaatatggataggaatgaagatcatcaagattcaagagaaaattaaaacccaacccaaggaatctaaggattacaataaaataacagggctgaaagacaaaatggctattttaagaaggaaacaaattcatctgatagagctgtaaaacacactataataatttcataatataatcacatattaaccgcaggaatcaactaagctaaggaaaaaaatttcagtgctcaaagactggttcttcagactaagtcagacaaaaataaagaaaaaagaataagaaggaatgaacaaaatgtccaagatatatgggattagatagagaccaaatctatgactcattggcatcactgcaggaaagggaaagaaaataagcaatttggaaaatatatttgaggatattgttcacaaaaatttccctaaccttgctaaaaaggccaacattcaaattcaagaaatgcagagaacccctgtaagatactatgcaagacgaccatccccaggacacataatcatcatattctccaaaggtgatatgaaagaaaaaatattaaaggcagctatagggaaggggcaggtaatatacaaaggtacctccataaagctaaaagcagaacattcagtagaaactctgtaagccagaagagattgcgggcctgtattcaggatccctaaagaaaagaaactccaatcaagaatttcatatccagccaaattaagcttcataagtgaaggagaaataagattcttttcaggaagcaaatgctaagaaaaatcataaccactcaacctgccttggaagaggtccttaagggagggctacatatggagaaaaaagactattatctgccaccataaaaacacacataagtacatagattattgataatataatgcaatgacactatcaagtctgcataatatccaggatcaaatccacaacatagcaatgttaaccttgattgtaaatggaataaatgccctgattaaaaggcacaggggagccagttggataaagcagcaagactcactgtgtgctgtcttcgagagatctatctcacatacattgacactcacaggctcaaagtaaaggaatggagaaaaccctaccaagcaaatagaaaacaaacaaaaaaatagtggctgccattctaatttcagacaaaacagactttacaccaacagtgatcaaaaaagaagaagaaggacattacataatggcaaagggttcaattcagcaagaagacataacacaacacaagagcagacagattcatagaataagttcttagagacctatgaagaaactcagataaccatacaatagtagtgggaaacttcaacactccactgacagtattagacaggtcattaaggcagaaaactaacaaagatattcaagatctgaactcagcatttgaccaaatggaccttgcacacatatacagaactctctacctaataacaacagaatatacattcctcttatctgcacttggcacatactctaaaatcaaccacacagtaagccatataacacttctcagcaaatcaaaaaagaaactgaaccaaccacactctcagatcacagcacaacaaaagtagaaatcaacaccaagaagattggtcaaaacaacacaattacatggaaattaaacaacctgctccttaatgacttctggtaaacaatgaaattaagacagaaatcaagaaattctttgaaactaataagaacaaggatagcacataccagaacctctgggacacagctaaaatggtgttaagaggagagtttatagtgctaaacacccatatcaaaaatggcagaaggatctcaaattaacagcctaacatcaacatcacaccttgaggaactagaaaaacaagagcaaactaaccccaaacctagcaaagtcaagaaataacgataatcagagccaaactgaatgaaactgagatgtgaaaaagcatacaaaagatcgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtccaagctactcgggaggctgaggcaggagaatggcgtgaacccgggaggcggagcttgcagtgagccgagatcccgccactgcactccagcctgggcgacagagcgagactccgtctcaaaaaaaaaaaaataaataaataaataaaagatcaacaaaatcagaggttgtttttttttttttaagaataaataacatagaccactagctggactaacaaataaaaaagagagaagattcaaataaataaaatcagaaatgacaaaggggaacataacctttgaccccacaagaataaaaaaaaccatcagagactactatgaacatatctatgcacacaaaatatatgacctgcaagaaatggataacttactagaaagatataacttcccaagactaaatgagtaataaattcaaaccctgaacagaccaataatgagttgaagtacggaatcagtaataaaaagcctaccaaccagaaaaagcccaggatcagacagattcacagctgaattctacaaaatgcataaataagagctattaccatttgtactgaaactattccaaaaagttgaggaagagggactcctccctaactcattctatgaggccagcatcattatgataccaaaactggaaagagacacacacacacaaaaagaaaacttcaggccaatatccttcatggacatagatgcaaaaatcttcaatgaaattctttccaaaaagtccttgtttttttgtttgtttgtttgtttgtttttagaataaataaatccaacagcacatcaaaaagccaatctactacaatcaagtaggctttatccctgggatgcaagattggtccaacatatgcaaatcaataaatgtgattgaccacataaacagaattgaaagcaaaaaccatatgatcatttcaatagacgcagaaacagctttcgatataacccaacatgccttcatgataaaaaatactcaacagaataggcatcaaaggaacatacctcaaaataataagaaccatatattacaaatccacagccaacatcatactgaataggcaaaagttcgaaccatttaccctaaaacctgcaaagggtgcccactcaccactcctattcaatatagtactggaagtcctagccagagtaatcaggcaaaataaagaaatgaaaggcatccaaataggaaaagaagaagtcaaactatctctcttcactgacaatatgatcatgtacctgaaaaaacataaagactgcataaagccttctagaactgaaaaacgactttagaaaatttcaggataaaaaaatcaatgtgcaaaagtcagtcacatttctatacactagtaatgtccaggatgaaaggcaaatcaagaacacaatcccatttacaatagccacaaaaaagagaaatatacaggaaaatagctgaccaaggaggagaaaaatctctgcaggtagaactacaaaacactgctaaaagaaatcagagatgacacaaaaaaatggaaaaatattccatgctcattgattggaagaatcaatatcattaaaatggccatactgcccaaagcactgtacagattcaatgttatgcttaccagtcaaggccattcttcacagatttagaaaaatctattctataattcacatggaaccaaaaaaatgagctggaataaccacagaaatcctaagcaaaaggaacaaagctggaggcaacacaatacctgaatttaaactatactacaaggctacagtaaccaaaacatcatggtactgatacaaaaatagacacatagaacaatgtaacagtatagagatccccaaaataaaaccacacatctacaacaatctgatctttgacaaagttgacaaaacaagcagtgaagaaaggacttcctatgaataaatggagttgggataactggctaaccatatatagaaaattgaaactggacctctttcttataacatatacaaaaaacaactgaagatggattaaagactttaatgtaaaacctaaaactataaaaacccttgaagaaaacctagaaataccattctagacttaggcctttgaaaagatattatgacaaagatgctaaaagcaattgcaacaaaaacaaaacttgaaaaatgggacctaattattaaagagcttctgcacagcaaaagaaactataaatagagtaaagagatagcccatagaatgggagaaaataaatgcaaactacatatccaacaaaagtctaatatccagaatctataaagaacttaaacaaattaacaagcaaaatacaaccccattaaaactaggcaaaggatatgaacatacactttccaaaaaagacatatatgcagccagcaggtatacgaaaaaaaatgttcagcattactaatccttagagaaatgcaaatcaaaaccacaattagataccatctcacaccggccagaatagctattattaaaaaatcaaaataactatagatgttggcaaggtaatggagaaaagggaatgcttatatacatgcttttgtttggaatgtagtttagttcagccactgttgaaagcagtttggcaatttctcaaagaacctaaaaccaattgaggcagaaatgtcattattggatatatacacccaaaggaatatatattattctaccataaagacagttgcacatgtatgtccatcacagcactatgcacaatagcaaaggcatgaaatcaacctaaatgctcaacaacagtaaaccagatgaagaaaatgtacatatatatacaccctggaatcctatgcttccataaaaaaggaatgcaggctgggcacggtggctcatgcctgtaattccagcactttgggatgcccaggcaggtagatcgcctgaggtcaggagttggagaccaacctggccaacatggtgaaaccttgtctctactaaaatacaaaaattagcctggcatgatgcatggtgaaaccctgtgtctactaaaatacaaaaattagccgggcatggtggtgcatgtctgtaatcccagctgctcaggaagctgaggcgtgagagtcgcttgagcctgggaggcagagatttcagtaagtcgagactgcaccactgcactccagcctaggtgacagagcaaggctccatctcaaaaaaaaaaaaaaaaaaaaaaaagaatgcgatcatgtcctttgcagcaatgtggatgaaggtgaagaaaattattcgaagcaaacttatgcagaaataaaaaaccaaatactgcattctcacttacaagtgggagctaaacattgggtacacatggacgcgaagggaacaatagacacttgggcttgcttgagggttgagggtgggaagagagtgagaatcaaaaaactacgtatcaggtattatgcttattatctaagtgatgaaataatctgtaaaccaaacccctgtgactcacaatttatctatagaaccaacctggacctacacccctgaaactaaaataaaagttaaaagaacaaaaagagcaaagaatttggagtcccaagacccctgggacttattagccgagtgagattgagaaggacattcacttgttttaagtctcaggttccttatctgaaaggatatcatttgaaaacagtacacatcttacagggctgtgatgaagactaaataaaactgttgacatactggaaagttttgaaaaatgtacctgacttcaaagactgaaatttcactgcagaaaaaaacttttaaaaaatcttcatataaaaaattactttaaaaaaataagcaacaaagcaataactcaagacttcatttatagcattggcctatttccacggagtaaatactcccaatatatccaatttcctggtacccacttgacaccattgaatgtaaatttgagattgtgcaatagcaaaacattctataggatttctaatattaagatataatcaatgcaaacaaactcaaaagcataggcaatagtaagaggtaataatatatttggaaaggatgaattttgagctttaattattttgcatttaatgtaattaaattgttcattaatatagtttgatgtttaatcatatctgtttataatatggcttgcaaaattcctgaaaatttaacaatcagccctcataggcctctttggatcaaatgaccagcaaggcataatactagcaagtaaggaggaatgagatggctttggctttacagattttaaacatttaaattcacttaggtatatagtagaagcatttttacttccaattgtgcttaatctaaggaaaatagcatctttgaatcttttcctttttctaatcaacttttgctcctaattttccattctagcttctaatatccctagattaagaacaaaaataacattgatttccaccacagataaaatgtccaataaaaggcaaagtaaaactggaatcaattgaatattctctgtttaacaccaaattgattttaaggctgccagataaggaagggagaaatagaatgtaaagctgtcctgagaagagatcactcagtctaagcccctcattttgaagatatgaaaatggagatacctcaagattggcctaaaatcaccgaacccactagcagcagagcaaagacaagaatgctgggctcctgagttctgaaagccatacctgttctattgctgtgcaccaaaccttaattcctgggccatctttattagaagagtgtttggcaagttctttgggtgtgaaaagagaaaacagttctcataaatcaggtttccatgcctggtctgttaaatccaccactggcacgatcacagggaagtgctgctccagctcattgtgctagaaataaactgaggtctcatagcagccattagagtctaattatatgtgacagccaacctgacaggttttgtttatttgtttgtctattctttcagtgcttatggcttgaaaaaaatgaataatgctgtcaaaactatcttacccttcaggagctctttctctgcttcattggaaagcataggaaagcatttacttctgacacgcctggtaaagctaataaggaaaaatgatttcactgagaagtctgtataattatgcatggctcatgtgacacctactgatggtcaactgtcactagtacactgtgatatacttgataagagaatgagaatcaggagcatcaaatacatagaaatcacataagaagtcttttcggaagaaatgcgagctatgaaatcatctgaggatgaggcaacagatatatctagaaaacatgagcaaaataaaacataaaattgtataaatttcataatggaactagtggacaattgacagattatatttaaccctgtcttaatttatttttcccagaccactcaccttttaagaatatcaacattatatttgtactgaaagtagatgtgataggtagatcttgattattttcgagtcccaagcagatctctatgtttttcttgaatgattccaattttaccaatgatctagctaaggacattgacatgttcctgaatgcctctaaacaaagtaaaaaaaaacaaacaaaaaaaaaaacaactttgaatggcagtattaagatccaattccttatcaacatgttgaaatgataatgtgaacttaataaaatatagtaagactcaacatattaaacttaagaagagttaaataagtaaaggaaaacaaacaacaacaacaaaaagctggagtggggaaaatagaatctaatagccatctgtatgagaaaagattttatttggctgcaaactcatgagttgatgttgtaacaagactgcaaacagcaagaatgtgaatatattgaatcttgccttcctctgggaagtgccaatgagagcttgtactagctccactccattccagactggaaagatcatgcctagtgtgccatcagcttgagaaatatgtgtttttatctcccatggctttgattaagttgggttacatctggctactactcagtctcagtttggacagtgtgggctccacagcatttgtccactcctcatttacttgcagaattctgttgtctaagttacactttttacactctgttctaatgtggctactggtgaggtgtaaacgttgttttgccactgtgaaaaatataaaaataggttttacagtgctccattgtatatacttttatatacatagtgatttctagaactaaagctttctacattattaagagttgattgtactgtgtttaattgtaggcaagacattaagtggtatgtttaaaagttgggtgtgcttacataagaatccccaagaagagaaagactctgtaaaccaatatctatgaggaatagttgaaaaaaataaagaagacttatttatgcacaagaaaaagagaaaaaattagtgggtaattcttaatggaataattacttagaagatgaattgtcattttttttggaattcagtttatttttgtgactgtcaggatgaaagttgcaaggtcacagattcaggtcagctttagagcaggttgaagtattagaaaatggaatatgatgctttataatcaattttccattcatggaggtgtccaaagggtactgaaatatacatgtattaacagttttataaatgggagtgattaattagatagtcttctaatcagtgagttacaatattcttttccactgcaagaatctatgagtcaatgttgtatcattgatgacatgatgacaaagaagctctatacaaccttcattttggttattttaatttgtaatctctcatttgaaacatagcactgattgaaaggtattttaaagtattatccctaccactcattaacacaaatcactcaacctagaagaacgtgtggtggctgtttatagacctacacctactttttgatattaatttttccttctagattttcatatatttaattagcttacaaacaactcacctattaaattataaaacttatgtatagatttgatatagcatagtttttacataagaatgtttaataatgaagagtggtgtttaatcaacatgttgaatgtgaagccaattcataatttgaaaggtcaacaataaaggggcatcatccatcatgatttaatcagtcgtatcttattaagagcagttgcaaaacaggtgagaacattcacaaaaggattagtttataatatttaggttaacatttaaaaaccatcactagccgtagtgttcatgatattaattatatagaagtatgccattttctaaaggagcaggaaaacttttaaaatattaacaacactgagattagtcttcagaaatttaaaataaaattcaagtgtctttagaatttaaatttctttatgaggatgtcaaaatgataggataaaaccccaatgaaagatatatattgcaatattcatatccaaatgaaacttctcagatcatgagtctattaccatactccattatcccgagatgaagcgattacatgttctgtttttatttttcaaatactgttgactgccaaaaagaaactagtgaagatattctttatgccaaatttccttgtcttctttcattttttcagtcaaccaccatttgctaagcagcactatgtaccaagtgtcagttactctgccactatacacatttctgtgattcaaattagctcaaataagatccacaagtaaaggaataatgtttgtattatacaaaatttcattggtttacctgtgattttcataagccaaagtagccagatgagtgtgaatagattacaaccttcagtgggaaaggaaaaagccatcatcttagctactgccctggcagtgggagtcctttcagaacattccaactaagtgcaagcagttggagcttccttcccagccaagttcaccatcagttttgttcagccagtggtaagttgcactatcttccaggtttacttcaccagcagccccactctctgagatctccattttcatcgatttggactcagtactggccaaatcttcttaactaatgttgtttgtgaattactaaaatcatctgtggcaaccttcagctacactaagctgcctgcctaggtggtctaagttagctctgcagaaacttattactgtgtttgcttgtgctttggttaaaacatttacataagattttctttatcattgcctactattatgcagaatatgaggtttcctaataacatatataattacagagaaatgtctctattgtgatagtcgcaggagattcagaagtgaattatacgcagctgatgccttcacactgccaaggtttagtaaaaatgacatgcaaactatgagttttactacaatgtgatgagtgtcattgctatgctaaaaaatacaagaattcagaggttagaaggcccaaataccatgagttttactacttccctaatagctcatttcacaataaagaatttctgatcatcagaagcttattatattgaactagaattttcacttctttatgcaatcaacaaggacttattgatcagtttctataagtcaggaatgtttctggacaactggagtttgcttgagaaggaaaattggacctgacttagtgttacagagtttatattttagattcaaagattgaaaatcaacaaacacacaagaaaataaatgaatctgtgaacaaataaaattgtttcagatagtaaggaaatctctgaaggtaaacagagtaataggacagaaagtgaccgtgtagattaagggtgtcaatactctataggctagtagaagttaagctcttctgtggagaagtatgggtttcagctaatggaagtcaaggagagatttacagcctgaagtcaccaattatgcagagccttcaggcagggacattatgtttggcaggagggcagacatgggaacactggctgcttgggaagataagaagaagccaggcaatatactagtccttaggaatttggatttgatttggcatgagatagaaagtcactgaattgtttttagcaggaaaaggacatgagatgatttattttgtgaaaatataagttgacggccagatgaagaaacaattgttaggttataggcatggaagcaggcagttaggtgttgggagacaatagccatgtgctaagtgaggcgttgcagtggtttgacagggaaaacaggggccatgagcaacagagatgaaatagataaactagagtatattatggtgacataatgtgtacattatatcatttggggatagatggaatgtgcttgtgattaatccacaaccatcaaagtccaccaagtaaacaagaacagttctctgcatctccactccattactgatgtggtttggctctgtgtctccacccaaatctcatctcaaattgtaatccccacgttcccaggttccaggatcacgggggcagttcctccatgctgttctcatgatagtgagggagttctcacgagatatgatggtttaaaatgggcagtttcttatgtgcacactttctgtctcttctgctaccttatgaagaccttccttgcttctccttctccttcctgcatgattgtaagtttcccaaggcctccccagccatgtggaactgtgagccaattaatcttctttcctgtgtaaatcagtctcaggtagtatctttatagatgtgtgagaatggattaatgcaattaccttttttcgttctttgccctcattcgctgaggttttcaaactacaattagatgaaaactttttgtgactgttacagaggttttcctgcctctatttagacattggaacaagattacctttaaaagggggtctagcatatgatatgtagatgggaatttttaaggaatatgattcatttagcagcatggactattagtaaaaaaaaaaaattatattaaatggcattctttccatatctatagggccaagtcgaaagctctccattatagctggagatgccctctttaagcttttacattctccttccgcccccaacatacacgctatacttatacacgtatacttttcaaccttcaacctccctttagaaaaataaaaattatcattaagtgctcagatcaaaaagtaataggcaatgaaaaaaatattgatttgtattaaatcaccggtgcaaatatggtgtgcgaggataagaatgtttggcaagagctacagtattataaaataaatgatatgctagtcatcgaaggcccttgtccatgtaagtgagcagaaatatatagcatttgcttattatctccagcccaagtagtaaattatcactgaaatggcaaagactgaagtggacataaatttggggttcgctgtgctgaggagtgtgggggcttggtatatttcaaaagccttaggaggctaccgatcatcatgatctgcagacagagctgcagataaagtataaggtgatttctagttggaaacttaaccaaggctctcatggcttacagttagaaaattattttcctctagtacagagtttacagattaccttttatttctttttagcttcaaacctattgttaaaatatcaaattatttgtattttcctactctctgtgaaagaatctttttaaaaaattaacctttctaccatttgattttgattacagaatgactgatttactcattaattacctattcattcctacactatagcagatgctattctaggtactagagagtgatgaacaaaagagatgtagactctgtatcagagaatttataatcatgtaaatgttataaagatagtgaaacaaaaaatgactcataataaaataaaataggagtgatgacagaggagaaaaatttaacttattttgaatgaaagtgtgtttgcataaggtaaggtacgtatgtatattggaattaactcagtccaggaagtggccgattttagagaacatagttgtcagtttaatctcctgatattgcagttagcgtattatctgattgtggctattagcttgcaaacagctgttgtttagccaaagcagaagccatatagggtttgcaaggttgaagacagacctgttaccacttctagtaagagactttcaaatatatggcctactgatggcttggtagtaatttcagcaaaaaagacaagtcctgttttcctcccttattattctcctatagattcagcactatctgttcgcagtctttgtatcaaggctgttctatttacattccatgcaaaagatgtttgttttcttttcatggtggtgatggctaatggctccctccattgtggcaataccttccagtgtcattccctatccttctgctcctttctctgcctcctactcccatgtagagtttctccaagagcagacttacttgattacctcagaaagccaactcctgtaatgtcacagaggcatagtactctatgaaactaagacgatctaagacacatgggagggaaatatgactggaaactatatttgctggttgctactaagagcctcactcagtttccagtgtctttctggtggttttacagcttttttttggtaacttacgattgtcttctctagtacccttcccaacaaaagaaatgtaggatattctaattattttgcactcattaaaatggacattcattttgctgaaatatagcttattctatatatgtttataatgaattatcttgtataatttttttatcttgacctatttttgtatgtgtaatgtcattcttttatgggcctgtgcattctctttagcattctaattcccattctagggaacaaattacagcacctttgtgttttaatcatcaattatcctactcaagtgttttaagcaccctgcaaacaatatctggtatgtgccttgcctagtttaattattgaagcacttttgaaagcaccaggatttcattagtgatcaatataaattgggccagtgttcaaccaatttgtgttcattattaaagccttcggttccaacaataacttggagacagagaactgatgaagctggttagacaattgcctaatgaggcaagcagactctgcctctgaccttaaccagcctctgggctctgaaaactttaaatggtcccagtgacagatatcacactagaaatcagccattgtccatctaatcactacctctagctgagctgagaggcataaaataacacaaatgaattgaatgaaagacagaatctatcatgctacaggtaattgtgtttatcaagcattaatatctgagactcaatcctagggctctaatccatctcataaaacaaagtccagagacaggagcaatcctcggcaaagaagccattcgtagaaagtaaaatttgtgggatccaaaaataattgacataaaattccagcaaaacagactgacattccaaaagcactttaaaattacaagggattgaggacacagatcttttagcagaaggtacagattaaccgggtcttcgacacatgcacaggatgtaggtgacgtgtacaactggagttaaatggcagttgagacaggtaggctttttctagttggagagctctcagggaaccggtgaccactttggtctggtacagatgagagatatagaaattatatcaggtgggaagtagacacctggccagggagaaatgcagggacataattaatcccatttctgctgagggtgacaacctgattagtgcccttaattaaggtcaggctttgagtatctttataaattcttgctatgggagctttgtgccaaatatatccatgtatatgtatagatagttacattatttttccctacatcaatttcatgatctctaaaatgaactgagagagatctgatttgaaatagtattcttacctgttctcaaaatctgaaagtccaggagtccatggggaaataagatagagtttttattacatattgaggtatcataactcttcctcaacatggaaacaaagagcttgcattatgtcaggtttgagcttgttagagacatcatttcagcaggctttttggattctgtgttggttgctactgaagtaaatttgcacagtactgttagcctttgggggtctttcttactcaaccactatagttgttgcagaattttgtgccttagttcagctaaaacctggttcttgtcacacgaccaggaaaatttggacacgttgaagggtgagtagagcaggattttattaggcaaaaagggaaaaaacctcacagattaaatcccaggccaccacacagaaactgaagagaccaggctcctcttgcctgcccatggctccaccctgttcccccagtgcacatgtgggcatgctccagcaaggccctgggcagcttccctcatctgtgccaaagcctctgatgtaaacacttatggagcaggtcggaggttctccagggttccctttttatctgcttaggcattcggctatctcgtagttaagattgagtagatctgggcaagaaaacaggggaagaaatggatataaatatgtgcctttcatcttcattaatttgaagcctcaagtttgtataagtatgtttccccaagggccttaacatcagatgttatgtaagtaggattttgattattcagaaaataaacttaccaagttaaacacagcgatattaccttgatttggaaaaaaatcatttagcaatggaattcaattttataccccggtacctaatacatgattccacagggaatcatgcttgattctgttagaaatactaatctggatgtaagcacttgccttcaaggagctttaaactagtggaatgtaaaaaaatgcactagaagataatgtagactgtgagggaaaaaaatgttatgtgatagagatgagtttcagttagcaagattgggcagattttaagaaagagggggtatttgactgaatcttgaagcaaggatagatagaacttcaactgacgagtaataaaggctcaaaggggaatagcatttgtttcattaatgtgctcctagagctcagcttgcataactcattttttataagactaagtttatgcttaaaaactcaccgatgtcatcaaaaatctaataggaatatgaacattttctgctagtggttttggtctctatgttagttctatacttttttttttttttgataagaagtatggatggtgggaaaccaactgctttgatggaaattcaagcaacagacagatcccctgtcagctccacacaaagatatcctgatgaagttctcctgacttctaggagggaatgtttcggaagtgcacatgagggagaggaatcctgctgtcagctgactttttcctttgcttactgtatttgttttgttttgttttgtttttaaaacaggcttggacatacattttcaattcgaaaactcccttctgagatccaaaagtaaacatgtttacagattatgcaaaagtttgagtttagtttcagaatttttctctcaaaggctctagcacaaaaaaaatgggggatgtccaaattctggaatttgaaacaaataacaggacagattgcaagctggcagctggcagggagaagtccattatttcccagctccattcctttgacttcagcctagggaaaggttaccctaaccttgcctcaccttattacccattctatttttaagcatttctcatttactgaaaaatatttaccacatacttctagtggatctaatcattagattcttaggtggacgcttctcaatcaatgaaggacagaacctatcgagcttcctgacctctttagttcctaaaacgcggcattctgttttctctttttactactaataaaggcagttaacattcactggtgggccacagtgaaaacttcagatagttttctgaaggtttactactttctatttagttttgttctttttttttccctaaaaattagtgggttccccagtttgtgtattgtaattccctttttttgagtcttgtttttcctcttcttctgtgatttctactcattcccgaaactctgcatagtaatcatgaccaaatgatttctgaattcatatatcaaatcccccaaaggcttaatatcatctcagaatgtcagccaagctcagatttccaaaagttttatattattacattggcttgaatcatagacttgtgtccttctgtagtcagcacccattccttcacctttaggcatagctccagttctgagagacctatccttgcctctactgacaacagcctggtagggatatcagtaaatgtagccagacatgtatattgccacatggctgctgcatggccctgattaggccatcttgatctgattgaaacaaagattagaaatagtagaagttgattcattccaaatacttgatgggacagcacatcaaatcccacagctcagacccctggagctgctctggtctgtgtgttttctaagcatacctttcaaaccctccctctgtttctacaaaaccctgtgtatttttcaaaggaatctctttttatgctaggaagaggtggtctctattgtctgcaaccacacacacacacacacacacacacacacacacacagatattctcaacaagtagtttctacaatgttgataggcacattgttagagatggagttaaaaaatcaattcctgagtcctaaatataggcaacttttatttcaatgaggacataatacatccataccagagatcattataataccatgtattggtaccaggacctggaggatatattgaggcatcttcctaaaacttcaacctaagttgctatctgagatttaaaaccaaaacttaagggacaagacataagccgcctcatataataaatacaggacaacttctttgccatcaggacataactgaaaactaaaacacatatttgtcaaaaggtgtgttggtaaatgttggaagaatagatttgtaaaagtgaagtttggaagttttcataaaagaattaattagtagagaggggagtaccttgaccaatgagcttcctatatcagaggaaggcagatgagacacaataatctgaagtctaatgcagtttgttcaaatcctggataacttgcttaacctgtctaggtgtcagtttccttagttataatttgaggataataacagtataaattattattagtttattgtgttgattatatgaaataatccatttcctatagtttttactgcacatgggttaatataaaatattatcaacttttttactattattattgagttggcaaagttattcctattatgggaaaagattatcagacattttagcccagtgccttacaaaatttggatcttatcattcttttagttctgatcctgggctcatgaagcaaccttctgttgctaactggcatcctacataggcctgccttgagggaagaattgctctgctaaggccaattagtttctaaggaaactctattttaatacataaaccaataatttgatttttttttaaactttatagatcagatttatttggagaaaacaaaacaccgacaacccaaaggatgggattttacgtcaagacatctcccaggtaataagtctacagattaaatcattttcatggaagatatttttgtacaaattttacatgtattcaggagccggacattaatcaatccctgtttctattttaaaagggaggacaaagtaggggagggggaaaacagttttggatataactatttggaaggagagtagacatgaagagggcaaaccctagcttttcattatctacaaccaatgttttttttcttttaaaaaaaaaataaaacaaaaacttttcaatcttcaacactctttaaaagcccacttcttagctactggccaatccacagcaattatttaattcacttggtacacacctttgtcctctgggtaaattatattcattatgcccactgctgcagcacgcataaaccaacacccctgcatggctgaacagggcctaatctaggactgatgggagaagggcttgcaaaccaagatcaaggtgtcgtttctctgctaatactgtctacaaagctgatccctacaaaaatgcacataaaagcaggcaagtttatctactgtgttgcaagggaaaccaggactttgttaaatagttctctccattaccatttgttctctcaagggaagcttaaaaaaaaaataaagaaaaacagcacattggtctgcccccctcatgaatccaacaagcattggtgtggcatttcagtggagaaggaaacttggggggaaaaagcccatcaaggttgtaagaagactcccaatttaactgtccctttccctatttatccaccatccaagaccatccattattctagagcactctgatctataaaaggggtcaaagcatcaggagcaggcaaggagtgagaaccaaaagacatcaagaaaccgatttgcttgagaaaagcagcgattcttcctttcatagctctccatggctgagagagaaaatgcccgagacatcatgtatgtgacttagagactgcttttcgggaggttaaaagtagcatgaagagcttaagatgacgataagagtctaaatttttagtttcaaggtttcagtagaatgtggatatattcaaactttcaaaaaggacagtgtttagaaagggtaaaactaggacacagaaaacattgggaattaccacgacctccaagtgcttccggctccaggaaataaccattcatgtgtttgctggaggtcacataattttcccctattacctggtgcagaatgactcatcacttcccaaaagcttcttttcagtccacaattttcccatttattttggtgcaatgcagtcccattctttatggcctaccgtctcactcccaactaccctcctgggagtaaaaaaaaaaaaggaattccccctaggctggcccccaaaactcagaattaaataagaggaggggctggcagcctcctggagactaaaacaacttgaggctaaatctacctttccaagggtggaaaatttattcagataatgtttgagaattcatatatgccaccataggataaaaactaaaaggtagaaatctcacacttttccttctacctccctcccatactgcccaaccaggttccaggcgttatatcactgtcattaccacttctgctaaatggagacctctagtttgcttttataaatcaaacttgtgattttggcaaatgaatgccagccttttcatccagctcctagaggtaggacatcctatggtagacacaaaccctggggccttgtggaagcgtttaaatggctgaagcatcaaggaagccttctgagaaatgtttaagagttaaccaggtcaaggagataatgaagttctcactgccaaggtagtatagggcaaacaaaaagcttaaggtgtcaagatatataaacagaatggggatgggggtggtgtcatgtgaggggactacaagtacttcagggttgctaaaataagagttaaaggcagatacttgtaggagactgggcaaaaagtctggctgggtcagtatttaattgtatgcccccccccaaaaaaaattaataagctgaaatcctaaatccaaggacctcagagtgtgaccttccttggagatagagtctttactgagataattaagttaatgtgaagtcattagaattggttcaaattcaatatgactgatgtccttataaaaaggggaaatttgggcacagacatgtatagaggcagggtgatttgaagacacacggggacagatgaccatctttcttccaggctaagcaaagggacctggaatagatcctttcctcatagtccccagaaggaatcaaccctttcaatacattgattttgggcttttcacttccataattgtgagttaacacatttctgttgtctaagccactaaatccatgaaactttgttatggcaacccaggggactaattcagccagattttaaacctctgtatgtatctgctaatgagcttataccttctttgcatgataggaaagcattgaagtgtgtgtgtgtttttttaatgtgtgatatgagaggacttggtgtttgtatgcattagtgtgtgtgtatgtttatagatcattatgatatccctgtggaagatggattcctggagactaaatattcaagtcaaggacatcagttagaaaattattatgttaatccaagtgagttattactatgtgcactaagggtaagaaaactttaatatcagaaggactcaggaattgtttacaaaggtagtggaatgacattcagatgggctagaattggagccacactctcgggatgtgtgttatcctctgccacctgctagctgcgtgaccttgagcaaggtacttaaccttcttgatcttgatctcatttctttacagtttgtctgtccactgaagccaacaaagtttccaaatcataaacctgattgtcatttcattttctcttcttaaaaataaaatagtcccatggcgcctgctcttaaggggctcacaagtgggacaagatttccttccttccttccttccttctttccttccttccttccttctttccttccttccttccttctttccttccttccttccttctttccttccttccttccttctttccttctttccttccttccttctttccttccttccttccttctttctttccttccttccttcctaccttccttccttccttccttctttccttccttccttccttctttccgtccttccttccttccttccttccttccttctttccttccttccttctttccttctttccttccttccttctttccttccttccttccttctttccttccttccttccttccttctttccttccttccttccttctttccttccttccttccttctttccttccttccttctttccttccttccttccgtccttccttccttctttccttccttccttccttctttccttccttccttccttccttccttccttccttccttccttccttctttccttccttccttccttctttccttccttccttccttctttcctttcttccttccttccttccttccttctttccttccttccttccttccttccttccttctttccttccttccttccttccttccttccttccttccttccttccttccttccttccttccttccttccttccttccttccttccttccttccttccttccttccttccttccttccttccttccttccttccttccttccttccttccttccttccttctttccttccttctttccttccttccttccttccttctttccttccttccttccttctttccttccttccttccttccttccttccttccttccttctttccttccttccttccttccttctttccttccttccttctttccttccttccttccttccttccttctttccttccttccttccttttcttccttctttacaccccatttttctttaattaaagtatctaaggctcaaaaccccagcccaattttactctcatccctgacatgagtttccaatcacgatagatactaatttaaaagcacctttcttgagtccttttcctttactttaccatccatctgtatgatcagtctgtctttagtcactcctggcttccaatgagtgatttcctctatacaataatgttcaacagcttttcagtatctgttgcattaaatgcagaatctcttttttagcattctagatcattcatcattctaaaacacctttcaactttatctcccattcttcccctttgtattccatctgcattgatcaaatgagattatctcatcactgcctgattctacgcagtcccctctcaattcatgcacttcttctccattctttcctatagaaattctacccattcaacagggtccttcctaaatgccatttccaaactaaaatgttctctgcattagggtactttctcagtggtgtgtagtaaacatttactcagacttgaatgagggaaatgaatttactggcttaaataattggagagtctgaaagttattttcagttttctctaagtggtgtgtgtcttagtttcctgttgcttataacagaatacctaaaagtgggtactttatacagaaaataaatttatttcttgaagttatgaaggacaagaagtctaaggtcaaggatcctcatccggtgaggaccttcttactggtggggactgtctgcagaatcccgagaaagcacaggacctcacatgagaaaggatggagcatgctagctcaggtctctcttcctcttcgtataaagctaccagttccactttcatgataactcattaactcattaatcagtgaatggattagtccattcatgaatgcagacccctcatgacctaattacctcttaaaggcctcacctctcaatactgcaatattgagaattaagtttcaacatgaattttggagaggaaaaatatgcaaaccatagcagtggggaaaatggctccctttccccatctctccatgcagcagctctaggctacaatttataagtgtagaagaggagtgaaactattatttttattgttcagaaaagaaaggaaggaaggaaggaaagaaggaaggaagggagggagggagggaggcagagggagggaaagaaataaattccaattggctctacttgtgacagatgatcacctgggccaattacttttccaagagatttggaaagtctgattggatagcttggataatgttgagagtggcatggcttttgattgacagcccagacaggaacagatgaagtgacaaagaggcatttataaaacaatatgtagaaaagataggagtggtttggaatctggtgctgcttagtcaatggtagaagtagagacagtggtctgaacactgccatagaaacatgtgctagaacgtttattggctaattatatttcttatcgctgtgtgcatgcccctgtatagtgtgactttaccatatctcagttaagaggcatttcactcccttgatcctgggctggatttgtgatttgctttgaaccatacaatctatcagaagagacaaggtatgcaatccagagctaggtccccagaggccttggagattttgtttttgatgccttaggacactgccctgacattaccatcccaatgagtaatgaagacagatagccactgtcccagcagttccagttgagcctagtccccaagcaacccaccttctgaatgcagcacaggtgagcccagcaaaagaatcactcagccaaaccacagaatcatgagaaatgatgactagttattattttaggacactaagtgtggggtggtttgtaacatagccctagaaaactgatgaagaacaggaccaggcttgcactcccaggagagcacgaagaaaagttctcaaaaccgatcagtattactagtgtgttttggaaataaacccaatgagaaaaaacataggctatttattgagagtttgttatagcaagaaagtcagccaccatcacttgtgtttgggcagagactcaaagtcaggcagaggagtagaaaagccttagagtggataaaaaaggaaggcttcagctgtgccttggtgacagggtattggcaggaggaagctggaggtgagctgactagatacagggtccccatgtgattgattggggggcatatttatctatctttgtttggctctaagttggaagtggggtaaaaattagagaagctgtcaattaaattgtggcctttttgagccagttgtggcaaggcttgttgtttggcttcctggactggttgctgaagaaagtggtccgacttgtggcctggttactgtaactagcaggttaggtgcctgtgctgttgttgcagactatgagtcagagttctatttttataggcactctaattattgtccatttgtctattccgtttcttaatatttcactttgttacaaacagaaaaaaaaaacctctctctgaattgttcggaacatgaaccccagaatgggtttaatcaagataaactaaactgtgagaagaagacctttataaaatgttcattaagatggaaagatatgggtcaggagagctgggagtttgagtcctcgagggcacaggagtcacagcatttcaggggcaaagtagcaaagaaaaatcctctaaatggaacattataaaaggtcagcagagcaagacaaaaatatatattgctgtccatgttataaaagctgtcaaaaatccaaggcagcgtcactaagaagcctctttctaaaggcagatgcctggagtgagaataaaacattaactcattaacctttttattataaacatgtttattaatttcttaagagagaagggagttctatgagggaattggacttatgacaaataagttgtgatgagttcaatagaattgaaaaaagtgaaacacttctaattcacttagcaagaccttattgtgcacaagcaatatgtaaatcattgtttatcagtgagagcaatgcaaaacgtatgtgacatggagcttccctttaaggaatggttagtctggcagcctcgtggacactaaagcatgcctataaattcctggatatgatgtaaaaagtgataagtgtggtaacaggcaataggccatgggaatatggaagaccagaatattctcctttctctttagaaacatgggcaatgatggcacggagtagaagctgttaagaagaagtttaaaggaggcgtaataatggagctcttaaaaaatcaagtggaggacaagttcaagggctaaaaagggactttgggatctggaaaacaaattattaaagctacaggataaaggttaattggttggagtgttgagttagctgaacaactgaaaaaaaagtgaagagtgctagaaaaaaatatcagtttcagtcagacagtggaagacattgaatgcctagataagaatgctgacatttattctacatgaaaatgctcacaaagctttcaggaagtagaatattattcagaacagtgctctgaaatgaacaatcaagcagtggcttttacaacagataggtctgaggtaggttgtaatggcaccagataataattcattggcaaatatctaatgggggcaacagaaacgaatgagaagagataatagatggcctcaaatttccaagtatctgaccagataggggctgagaactgaaaaaaatggaaaagagaagtataaaatcaaaataccaaagagttgttgctaacttcacaataaagagccaaaagttatcactccatgtaatttcaaaagcctgctctccccctgtgacatcctaaagggacacatggaaataagttttgaaatggcatgtggccatatgattcattgtcatacctggaaattaggactcagagttatgttttcttttctcctttttgctatttctttgaagagctttctacaacccaaatactctgccagttttccaatgtatttgtgaaatggtgatcatgattttggctaccctcatgtggatttagagaagaaaataaattgaattcatttctgcaatgcacgttgaggatttcagagattttcttttatttgaagaaaaatataagcttctaaaatactcataacagccaaggttgggcaactgaaattgccttttgctctgcggagactgcgtaatatgagctggaaggaaaaaaaaatgatcctgaaacctgaggtttcacatcaacaactgaaaaaaaaaaatgtagaacataaattgtagttttcttgcagaatatttataacagctcacttgtagtactccggtctctagctgaacagggccaatggagaaacatttctcgattcagcgttttgtttgatccttactacagagtgattgatcacagcaatttctttcacataaacaaaatcctctagacaagcttgttggagacactcagggctatgaatacactgcagaccaaaaactaatattttgcttgctgtgtttaaactcagtgccaatagggctcaaatcacttgtatcataaaagcaaaactcttttaagcatcctgatttaattaggttccagggaaagggcattgcctaaacatgtttctcctgtagagaggtatctgtcttttcattagagccccaacatacaagcaacaaaacgtatggtttaacacggtgagcatctttaatcattaggaaactatccagcaactagctcagctacctcattttggagagcagagagccgtatcgggaaggaagagaaatggaggacagcatttcccgtgatcctgaacatgttctcatattgatgatggtcgtttctgccgccggagtagccggaattgtaatttgagaggagtgtcattttctgcagatacaaaccttgtgtaatcctcccatttaaatgacatgatcctgcaggctgatgatttcatggcccacaatttgtcacctccccactgcttgagagcgaaacggtagctaaacgacaatcaatagactgattttgtcatgcctgactgttcaccttgtttgaactaatttttagtttgttaattgtgttttaatatgccaccaaagggggaggtgatcattatttttttttaaaaaaaggaaagagattgtcaaatgaggtgaggagagggtgatttaagtgggatacattacagaaaatctataaagtcacccctgctccctggagtaatttccatagaggaaataaactagttacatttaatgtttgtgtgcaaaactgattttttttacttcttgttaatatgctttattttttctatcaggattcaaataattgtaactatgtaaacacctatatatgttactatgaatagatttttgtagtttcgatatggaaatataatttttcagagatagtgagcattcagttagtcactgattcatgtgtggtagaagtcatgcctggtaagatgtcatcttttctgtttaagaatctgtaagtagactggaaaagaaaggtttcagagtttttttgaatatcatgctttttggacaaagacaaatcttaaatataaatagactttaataaagctttaggacccattaattaaatgtcactttcaagatgcagaagtgaggctgaatgcagtggctcacaccagtcatcccagcactttgggaggccaaggccagtggatcaattgaggtcaggagtttgagaccaacctgcagaacatagcaaaagcccttctctacaaaaaattattttttaaaaatttgccaggcatggtggtgcatgcctatagtcctaactacttgggaggctcagatgggagaattgcctgatcccaggaatttgaggctgcagtgagtttgatcatgccactgcatgccagcctgggtgacagagtgagacccctaatctctaaaaaataaaaaataaaatttaatttaatttaattaaatgatgtagcaataatacagattagggtgtgggtgcctggattacctctgagtgaaggcggcttctggaggttcttaatcccccagtgattacagtaatcggtagtgtccctggaagattaacatactatggtatatgtcctctttgaaactgtttctttcctcttttgttggtatctgaacattaatatctttaggatgatgaccgcattcatcatccaaactgagaggcttttgaaaatgaaggaaaagagttattagtatgtatcctgggaatattgacaaaaactggggcagtccccaccaaactgggatgtatggccatgctaaatatctgctctctggactttcaggtggtatgatatgaaaattcacccacatctttacataaatatgggaatcgtacaactggttaaatagagtgtttctatatatggtatggtatggtggcaggtgtgacagaaaaaactagaaagtgaagaaagaagcatgtgaacatctttgcataaagaaactgcctagactttattactcatgaatgtaacatattagtgatttccagaaactagatagaatgaatgatctctaatagagaaccctcctcccccaatggttttgtatactattttctcaggatacttaataatttctttctaaactgcaaatgagaaaatgaagcataaatatggtcttgactttggcacacccaattatttgaattgttggtatcattttaaaataaaattgttttatattcctcttcctaaatgattcaacctcaagaccaattcaagtgttattcaaataatttgaatatctttcacttcatcccttaagaagtacaacaaacctatggttgggttgatggagagagattgatgtcatgccccgacctaggaatcagaggtgctagctaggctctgctcattagctcagagactagaatgagctgacctgcctctctattctaccagttccacttctaagggagccatttgctgaatagctgtgaccccttatttacagaaaattgcatctgtaaaatgaacaaatgtaaaagcaaaatgagtctgaaccagcatctctgactttcttcatatcatcaattttatgtttaatttttatatatataatcaaagttattatttcttctattgaataagtttttactattaggagctttgaatttgttgtcacagttgaagctataaaaagttaatccaggaacatttttgtaatgttactttttccttaaaatatttgaaaccttatatatctgatatacccatctttcatttttttaaatttcctttccattttgagcagaatcagatataattccttccatcctctcttcttttatcccttacttcacacaaatatttatatagtgtttactatttttcaggcactattcttggcacttgggatatattagggaataaacactaattccactgtggaggagctaatgttctagtggaaggaggaagacaataaatagggtaaataaatattgcaggttagacaataagtgtggtgggaaaaaaataggacagattggaggattcaggagtactgggtcaagacgtgagagtatacatttcaattttaaataagataagccccactgagaaaataacattcaagctacatgatattgtatgagcaggagctttttattttgcaatcagctgtattgtttcacatggggaaaactagagatgaaactcaataatatgacatggttgagataataaaataacaaaaaatgtataatattgggtgctctggtaatgactttgcatgtgtcattttatttaatcttcatgacaatgttatacaattggcactgttatctgtctgtgaggaaagtgagaccaacaataaccgacttgccctgggtcacacagatagtaagcggtgattccagaatttgtatctaggtagtctgattctaactctactcccttaattactagccatgttctcttgagttctttcataccaaggaaaatgtcgctattattcctgacgtatcttcaataacctcaataattattttgcactgtgtagggcctttgaaaagatggaggacacacattaactttccaggaaagatggtggtgctcacatttgataaaatgagagtttaacatcaggaatgaagaaggcatgagacttcctcttctcactaaaaatgggttatgcgtgattaggtgtttctcacccactcttaagagaaaaagcatgcatgattaatatgaatgggggttcaagtgcatatatcaaagggagaaacatcctcttgcattttaaagattgcaaataaatatagtttaatctgctatacataattcatattagcaacaaccacctcaaaattaatgtcagcccatgttaagatttgtgaatgacatctctaaagctttgcttcaggctattctcacagagactggttaatgcctttatggctaatttcctgaggcttatttttttggtctttcctgatgaaatattaagctctttttaaaaagagatttatctgataaaaaagtaaacccttgttcaacccgttacatagatttttctttaagatagggtgaggctttgcataaaaattgaaaagattgcagagggttcagtaacactagaggatctatgagatgtttttttcttattgaacttgacctcttactgttcagcacactctaaataagggatgttaatttcactcccaaacatactttattgctttggatattgagaagactgttaatctgctacttaaaaaatctcagaaggcaggaagtaattgcagaatttaacactgaacaatattaaactctaatttgactactcattctgatattaggggttatttcaaaagtaaagactagaagttctaagagtaaagagataagagttgtgtgctgtatttattctttcctcttcttttgggaagatgccagcaccccttcagtaacaacgcaagagcgtcttttcagacttctctttgcttttggtaaaaacatttatgtgtgtatcgaaatttgaacattctccctgaaatggtactcaaggagatttctaatcattcaaataatctcctaatttctcttatttccacctcaacgttcccaggcctttcctagctctgttctttttattttgttttttttactgtattggaggaaaaaatgcctatcttcactgccaaggccaacacattcatctctgccagagcagcattcacttctagtttcctctgggacattactcccttgggtacctattttcttactggtgttttttcacctctctttctaatgattcaaatcagcttccaggtatgctcagcctccctaccctaatatcataatccttctaaagtattttttctccttagtccttttctgccctctcctctctcttctcctcttgtattttctcccctgtgttctatccctcctctttatttattttccctcacttgattgccaaacttctcaaaagtgcaaactgtgtctactttcttagcatcctggcatatgaaacaaccatggccttggaggtaagatgactgggatttctttcctgattctatcttctggtgtgtaactttgacaagggacctgaattctttggcttgcaaataccgtattatatccctctagtttccagtgatggttacacaaactaatagatgatagaatcacatatcatttctcttggaagatagcaaattttcaagaagtaataactaacatgtattcttcagggtacacccttctcctttcccctaagatgagctttttaaaaatatcatctggaaaggagaagaaatagtacaaaagaataagtaaacattaacaaaaaatactgagtgtacataatacataacgtaacaaagcattagatgcagggaacttgggtcacagaatagacattagaaattccatttcttttctcagagctatgatgctgtggcaatacatgtaggagaggcaaagtgatgagagagaaccagaagcagactaagatgaggaatgtggttcttctaggttgtcctattgtgatagatggtctcacaagatgtccacaattaagtttattcctcccatgttgctccatggaaagatgggttttcttcctctccccttgaatctagactgcatttgtgatttgctctgactaatagaatatggtagtagtgatagttccaggcctggactttaaagggatggtggcttcaggatcctcccttggcagtgagatgccatgttgtgaggaagtccaagccaaccacatgcaaaagccaactgggaaaggagagatgactggctatcccctagtggggccagccattatggctgaggtactgctcatgtgaataaagacacatcttgtactttccaggctcagaagaaagtggagcagaaggactatctggctgagtcagcactgattccccaatgattagatataataaagtgttattgattcaatccaggaagttttgaggtaaatttttgcacagcattagataacagacacaattactaatgaaaccagcccaattgtcccatataaatgatatttacaggtttttgaatcaacatagaaattgatcttcctcatcttaaaacttgaaacatatctgagttccttcctaagaaaccaactctggggcaagggaatgagactcagcagatcaccgcatccagacaatgaaatgccagacccctcatccatcatgattgcttccttacccctccctaattcctctccacacatagctacatcccttccccactatataaatccttcaactttagttgtttggggagattatttgaaactgatctgtccctgtggcttcagcagctgattaaagccttcctccctggcaacatttgttgtctcggtgattggctttctgtgcagctagcaatgagacttagactgacactaacactaatatacttcagcaagtcatctgcatttgctgatccattctaatttatcaaatgagacaactgaactagctcattgcaaacatgccccacccagcctgaattctggccatccatcagttttgcatgtgcaagtatttttactgataaaagttagaccctgagttcaaaaagtcttagaacttcactcttatttcctttatgacttaagtcctctctcatctgtctttttctactttaaatgaagttaatatcatggatcaactagattaaatgagatagtctatgtaatacataattctggaatgtgataagtacaccactttccatgaaagctcttattattaatgaaagaaagaggaggtcccacagcctgacccagagttgtgtactctgatccacaccatcagtggaaaagaaagtgccgtttgtgagttctaaagataaatgctgtagatgttttccaacatggtgacatctctgtgtttccctccttaaaaacctgataataatcttcatacttctttggaaaacttaatagaatgtaatgtactgaggcatcacatccttagtccctcttaaattttctttgttagataatcagggcagagtatcagaagtaattaaaattaaactctgcctgaaaatatgttaataaaaagtatgatatgagattataagtattgttaagcaaaagttttagaactatgtagaaaaaaaagtacagaagacagtgttaaaaaaaaagaaaggaaggaaagcatggctagataaaaaagctgaagaaaaagttaaaggacatatggctctgtagcccactacaagtttgcaaaattcatttctttttgtagacacagcttgatataagctgaatcctgacaaattattctttgtattcagagtcacttaatttaaaacaatgtaaattcaaaggaagaagataatgttcctaacctcactgtgaccccagtccaattttgctacaccacctcaagcgagtcaaattcacaatttacatgcaggaagttaaccacaaaattagagcaactctttataggccccaaggttaagcatcaaaggcagaaatccaattaaaatgttatttggattttccaatagcaaacaatctggaaaacttaccagattatgagaaggatatgtatatgaaagctagagattatgtcttgcataaatcaataaataaaatttaaaaatgtttattcatttcttcaacagagatttatatttttgcagattacatacaagattttttaaagaattgtggagaaaagataaaaaatgacttcagccctcaacttaagaagataataatttttaaaaggtagctaaaacattcaaatatctatgatggtaggtaggatattaaaattctagatgagtgatgcacataaaatgagacagctgtttaagggaggagaaactccttccaggtttagggatggtaaggattgcaaatacttgtatacaatatctaacaagtacattagactttgaagatgcacacatggcacaagcacattgttacacacaattcatattcatttatttcagtcactcagaagatatttgtgcatacctgcctagctttcacatgctgataagacagtctctttcccgagctgtataatatgtgagtgggaagaaaaggtgctttatttaaattaaaattaaactataaggctgatttgtaaaatataaaagcaaaaaacctcaaatgaagagggtagacagactgacgagttagcaaatagaatcatctatcaattaacagtggggacctggatgtcaagttgcccggtttgaatcctgaatataccacttcctagcaaagctgaatttagtcatctgtaaaattgtgataataaaattagtagctgcttcttgaggattgctatgaagattagataccgtagtcctcccttatccacggttttgctttccatattttcagttgcctgcagtctgaaaagagatgaaaaactacaacaagatattttgagaaagagaccacatttacataacttttattacagtatattattataattgttctactttattattagttgctgtgaatatcttttggggcctaatttataaattaaactttattatagatatgtgtatctaggaaagaaacagtagtatgtagggtttggtcctagccatggtttcaggtatttactaggggtcttgggaagtatctcctgcagataagagaggactactgtaatacagtgcctggaatatagtacgtgcctggaaaactgaataattgccgacagtattaagattgatgtgaaactacctagacctggaagggcttggtggaggttcaggaaagaagaaaatgtttgagctaagcttagaatagtctttggacttgctggtcacaaaagaagagctttgttaaaacaaggacactgttggaattagcaatcactaaagcttcaaaatcttttaacttagaaccattaggttctcactcatctttggaatacctctgagatttacctgcattggcattgtgttcatctttttcttgatggaatttaggctcagagaattttagaaactcgtgaaagtcagaaaggaaactaattttctaattttcaaatatgatgccttatacatcaactagagaaatatactctcaattttagtttgcgaggtagactcgagtctaagtgatcctttctttgtgtactacacataactagttatgtcactaaaagacaaaaataaggaaataaataaatatataaaatgaacggtaatgtctctaccttaattcccacatcagtaaaacaaagctaaaaattatctttgcctctatatttctaagtaatgtttgatataagtatgaaccatgacatcttaaataaaaacctgagagaataaatgatctaaggggtgcttccaaggaaaggtgttatataaatatgatatattttcattaatagctataaactgtgagtccctgagaggatgggaccttaagcacttctgttaaacctcaatgatcttgtgaagatgtgtctggtcatcacattttctataatacaaacagttaaaacaccaacatgattagaagttaaattaacgataattagaaaaggcgataccaggaattgatttagtaattcaccctctgagatatcacttgtattgtgttcagtttcttagcttacctattctattttcaagtaccttattatgagtttatttcacttccccccaaaataatagattttagctttgtacgtatttgaaaatttataatccatgttttgtgcatgtgtaactctcagctcaccaatatatttcattatctgaaacagcctaaatcattccatatatgtatgtattactttataaataatgcacatgtgagaaagtgaggagaggctgcagatgttcagtaaagtgcttggttagacgcaaacaatattatgactggaagaaactcaactaattatccagttcagggttggcaaatttttttctgtaaaggccacacagtaagtattttagactttatgggccatacggtctctgtcaccactacttgactctgccattgtaccataaaaatagccatagataatgcaaaatgagtaagcatgacatattccaacaaaacctcatttacaaaaacaggcggcctgccaaatttggccctagggctgaagtttgccattgtataaactaatgcgactcacctatttcacgtgtgaggagattaaggcatagaagatttaagtgccattattggctattattaattgaattttcatggggagaaacagctctgtctgctaacatttttattctgctttgtcaatgaatcaaccttccacaaggcttgctggaatgatctttatgaaatgcagagcaagacgtgtcttttctgtgtttaaattcctttaacagatccctgacttccatgtgagattcagtctccttgtctagcgtatttaggatctgtaatcatgagatttctgatcactgcatcgattccatagcctactccgttttgcaggaaggctctattaagcccccacagtatgataaactgcatgacacataggaagtggtcctattttatttactttatctcccatgtctaacataatgcttgatacacagtagatcctgaataaatagctggaaaatgaatggataaattaaaagctgagatcagaaaagagttttaaggcaaatttgacagaatacctccttgcttggccctgactaaagtttcctgggtctcaccacgtgttcatggaaaatgaaaggactaggatcagaaaccccctcccaggtgaccttcatcagagctcacttcatcagcctgtctccctagtaacccatttctatattaatgtctggttactcacagggccccatctgtaccgctccttaattgtgcaaaaatattccacgaactaagtaaggacattgctatcgtattatccagcatggttttcatcagctggtcacacttccttctgcttcttcaatgtctctaaggaatttgattctccaaatgttcaatttgttgtgaggtagcacaacctagagttacaacttgtattcctagggctattacagtgactcacagtaggagaggatattttgatacctggatcactgaacccacctgggatgctaatgtatatgtccgtgtaatgtgtggaattaccatcaccagaaggttgtcttccccaaggcagtatccccttcctccaggaaaatgcagaattgttatcactgtaactccataccagcagcatcctttcaaggaaggtctcacagtcttagccaaaaagagcacactgtgatgctgatgacactgtttttactaagctagacaaggtttctttttaaaaatattggccaccaaacaatgggattgtgctttcttctgcttttaaaagcatgattttttttaactatctccactcaagctattaaattaactgattaaacatatttattagccaaatacttcctaaatcatcagattgatctggagactattcagaagggaaaactttttctctacccttttacattcagtattggaggcctatgaattaaaaggacaaaagacagattagcaagataaaagataaagtatgttcatatacatacaggagagcctgcagaaaatgtagctccaagaagtggttggaatagcatctgaactagtgggatgcattaggatttcaagggacaataaatggtgagaaatgactgtgaaatatatgggggaaattaatggaaggtaagatttgagtgagaaagtcctgtttatgcaatttctcatcccagtacccacttctcctctaaggggacaggagtcactccacgtggtacaggaagacttccttaaagggggatttatgacagttgatccttttggaacacttggcttttaggcagacaacaggaatgcagagaaagctccttcctgcatgtttggattctcaaatgcctttagttcaagataatccttatgccacaatgacataacgtgaaccccttcaagaaaaatgacactccacaaagaagaaaatcaaggcaaagaattcaatcattctggaagacaaaccttttgactaaggtacccaaataatattgtagatgtgttcgaaagccctaagttaatgtgactaagtattcactttatttttcaatcaagcagagccatcttattgaaagttgaaaccaggaacactctaattgaatatctcctcccagaagattaagaatttcttattaatattttatctctaaatgaatcaattaacttctcagtacaaactgtgcctctttttaaaatatataatttggtaaatttattatccaatatagcagagctgaactttttgaaaaagaagggttctctgttagtgtgtggcagcatccataacataattagaagctcagaatattggggctaaaaggtgtcttggtaagctcagcaactgatccttggctttatagggagaaaaagaggcccagagtggttaactggtttacccaaggtcacatagtgagctcgtgctttaactaggacttgaatcttgggctcagtcccattgaaatacttgaaaagagtatctaatgacttgtaggttaatgaatagaagcacattcatcagattaatgcagcaaagccctggatattgagaaaacacaaaatgacttagagctaattaaatacagacacaaattagaaaatgaggcttaagacagaatattaataatttctggtagatatctcatctttctgctcttaaagcaccctatgctgtcttctctcacaacataatgtcaccttcttgatttcaattcattatgcatgggttcaattctgtgctaccctcccatttatatgttgaagtcctaacccccaggacctcggaatgtgaccatgtttggagatgaggtctttacagggatcattaatttaaagtgaggtcattagagtggaccctattcctatataattgatgaccttgagaaatttggatgcagagagatgcacagagggaaaacaatgtgatgagacatagagataaaatggccatctacaagtcaaagagagaggtctgacacatatccttctcttatgcccttagatggaaccaatcctacagataccttgaccttgaacttctagcctgcagaactgtaaatcaataaatcccagttgtttaagccacccagtttgtggtactttgttagtgcagttctagcaaatgaatgcacactatttactcaatttttccccaaggcaacccgcacttctaccctgcccagcaccaacagagatggtgcggacttctccttatcatctcagaaacttccagtgtctggcttttcctgggtactcagttagtgcctgtaactgaattgccttacactaaatagagtacttgtactactctaactcaactcttattcacaacagctccctactttgggtagagtagtttatattattcttatttaactgatgattttccaaagaagataatgacattcccatgtaaggttacaaagtattacaaaggaaagagatgacaatccactgaaatgctttccaaatataatccaaatataatagtccagtctttaaaatctgagttgctttttgttgaatctgaaactgcctttaatttaccacatgcagcttgaggggtctttccagtggaaactgttttccgtcagggaaaaaaataagtaaacaaataaaagccctcaaaactgatcactaaatcagctcagcttatcaaaacaaaacaaaagaaaatcccccaattaaaacaggatttaaaacaatgaattcaattttggaaaagaaattgccaagtttgatttgtactgattattacgtgtttcaacaaactatttaaagtagtggatctttctggggttttacagagctctgtgtccatagaaatcctgaaataaactcaaatttaccaattttgtattgttttccaagaggagtatccactaacactgattaataataacaaatggataattatgtcattttatatgttcttttgttacacataaaaatctagtatttcttaaatgctggctacatgctttatacatcagttagcactctggcagaaaataaaatggtttaatgaaaagagtttaactgaagaaaatttaatgaaggcacatttgtgcagagtgacaggcaaagtaagggaaaaatcagtggttggtgaggtacccaaggctcagcaaaagtgagaagctattacaaccttaggcctgaagatgtggggagttaccatcagagtccagaggaggattgtgggggatggggtacctgagagggagtgtagccatggaggaacacagccacttctagaagagtggtaaggcaaggcttctctctggtcaggaccccctatgacctggcaatcccacacagaagtcccagccctgggagcccagatgatacactctgtaaagctctgttggtctatttttgcattgctatgaaggaatatctgaggttaggtaatctgtaaagaaaagagatttagttgtctcatggttctgcaggctgtacagaaagtatggcaccagcgtctgcttctggtgagggctcaggaagcttacaatcatggtggaaggtgaaggaggatccagtgtatcacatggcaagagagggagcaagagagacaaggtggagtgccagactcttttaaacacccagaactcacatgaactaatagttagagcccactcattactgcaaggatggcaccaagccattcatatgagatccaccctcatgacccaaacacctcccaccagtccccacatccaacattggggattacattttactatgagatttggaggggatacacacccaaaccatatcaagagcttaatctccagagaccagttagacaatgaatgggaggggcagtttcaaatggagaacagagtattttatatgaaccatctaactgaataatcttcaaaccccatgacatattttacaaatttagaagcacaagatcagagaagttaaaaatgtgcccagtttttaatgagcaagtagaatgaggagtatattagtctgttctcatgctgctgataaagacatacccaagactgggcaatttacagaagaaaaagtttaatggacttacagttccacatggctgggggagcttcataatcatggtggaagtcaaggaggagcaagtcacatcttacacggagggcagcaggcaaagagagagcttgtgcagggaaacgcccccttataaaaccatcagatctcatgacatttattcactctcacgagaacaccacaggaaagacctgcacccgtgattcaattaccactcaccgggtccctcgcacaatacatgggaattcaagatgagatttgggtggggacacagagtcaaaccatatcaaggagcaaatgaaatccaactttgttttagatctaatgaagaagaacaaaagaaaaatattgttttgctttcatacaatacatttcttttaaatgaaggaaggggaagagggcattatgtgaaacttgagaaaattgtagatgagttttatgtcaaaggactttgtgtttacttcagaatgtggaatgacttgacttggtgtggaagaggagcagagtcagtgaattgacaggaggatggagaacgtgccagacgagaaagtaatggacatatgttgataaggatgatcaaagaccaaagaatgaggcctgcccaggtggtgcatgcctgtagttctacctactttggaggctgaggctagaagattgattgagcccaggggttgggtcccatctaggaaacatagcaagatcctgactcaaaaacaacaacagcaaaaagaccaaacctcataagaaacagaaaatattaagaaatgagtgggataggaggttaaacaagataactagctctcgtataacactatataatttactaaaattttagtatagctcatatgacttgatactcaacagatccttgagagatctattataactatttcccgcctcatgttgtagataaaaaaacaagttcacagaagttaagtaaatggtagatatggaatttgactgctagcctgaagattgtctaatgaaccaagaataattacttgtttgagaagtctggaagtagtctgtgatatgaaatgtcaccaaactatgatgcaactctgtgagtactaaagtagaaatttagttgtttttagtcatttatctaatcaaataactatttctaatcaaggtatgctagctaactatgtattccaaatccttttaaaattttttattagacaccttgtgccccaaataagaaagctactaaacatgagtatagcccagggctttgataattttcattagcaccttagtttaactaatgcattatctgttaaataagtctgattaacacttctctacataatcattttctaatgcgtgcaactgttgcctctagagattaattgccaagcttttatgttcaactaacagtagattgacatttagcatcttagatttatagatttcctggtatgttattggactgttttctttggatggattcctccaaccatttgaaattggatttctccaaggataggtcgatgtaagcagtggagctaatcacatcattttacttcagcctcttctcacagaacttggtttattatgatcttaaaacctcctgggatatttttctagctctggatgtatctgaatgtaccaggtaaaatcaggactactgtaattcatccatttgctgtactatcttctcgttccatatagatacctttatgttgacatgacagtattagaaaaagacagctaccagagccctgcccacccatctacaaggtcaagaactattcccaccaaactattgaggccttgtatatactaggtgcttaaatgacatttgataacctggtttattgactttgaagaatactaatttagttacttatttaatattccaatgcacaccttcttcaggtaaagtgcaatgttggctattgaggaaaagataagtttgtggcttcaactatgggaatagtgttttagttcaaatcctttagtttcaaaagagataaacctttcaaactcagttaaaataatgaatgaaattaagtggaatcaaaggcaaggagtacagagaggtcattgcttctctgaacctaaacattattgtcattgtttctctgcatagctctgtgtttctgtgtcaatggccatcactacatttgattctataatatttctactgcaatcaagtcactaacataggcaaaggttaacttgttccaggtcaaaattcctaggaaaaagaatctgattcatccaacctgtgttaaaaattaatacttgatacaatcaactgctgccaatggatctggctcccgtaataaatcctcggccactaaggacagctgggtagaaatgactattatccaggaaagaggaacacacctggccaacccctttctttctgtagtacatagggtatctactttgaccagtttctgagagtagtttgcttcaactctccctcttcctctatgactgatggcagacaatctaacatttaactctacctctgtattagtcagggttctctagaaggacataactaataggatatatatatatacacatacacactcgtatatacacacacacacagatacatatatatatatatatatatatatatatgtaaaaggagtttattaagtattaactcacatgatcacaaggccccacaataggccatccacaaattgaggagcaaggacagccagtctgagtcccaaaactgaagaacttgaagtctgctgttcaagggcaggaagcatctggcataggagaaagatgaaggctgggaggctaggccactctagtagtttcacatttttctgcatgctttatattctagtaaaactagcagctgattagattgtgccaatacagatcaagggtaggtctgcctttcccagcctactgactcaaatgttgatatcctttggcaacatcctcacagacacacccaggatcagtccttttcatccttcaatccaatcaagtttacactcagtattaaccatcacaagtctacccattgtcaacttgaacccacacacatctcctgagctcatacataaccttcaaataaagacaataataaggtcataattacacctaacataatacaactatcttttgtacaactggaaacacaccaatacccaacccaaatactattacagaaagttaacaatacttaaatgctgctatgaggtcaataaattttatgtcacatgataaaggaaaaaggaaataaaatgaagatattttcttagtacaagtatatatgtgcacaaacatgtttttaaaaaaaggaaggaggaaatactcaagggaattacagtccttgtttctgcagctggtcttgggatcatagctggtattgatgactaccttcttctactgcccattctatattccctttgccttcagcaagaacctcagcaggtcatggttttgttttgttttgttttctggtggagtgacccaaacctttattcctgaagggtgtgtgccatttgtagtcctgcctggattgggctgttgtagtttcccattgaccttaatcagagggcatggtaatactaagagacgccctaatggatctcctgtattccatgcatactctcccttacctctgttgtagagtggtagatgatttcatcttgatagtctggatcaattgccccagccaacactgtaactcccttcttagcctgttgacttaaaggtaggaggagaccaaagtgtccaggtggcaatcctaacttccagtttagtgggatctgggatcgttgttgtgtatcctggtggaagtgttcctccctctggaactaagacctctagcccagcagaaggtaatattgcaggaacaggaagcaaaaattttgctagtggatcacaggggtgatggtgagtggtgccacttccacttccaccccttgattccaagacccatgaatcctggctatgggagaaacagtaccatatattggacactgattcagagcatacacgggcttctggagaactttgcccctgccctgcaaagtattgtcacctagttggcattgtaattgtgacttcaaaaggccattccacacttctatcaatccagctgcttcaggatgatggggaacatggtaagaccagtgaatttcatggtcatgagcccactgccacacttttttagccataaagtgagtgccttggtcagaggcaatgctgtgtggaataccatgacggtggataaggcattctgtgagtccatgggtggtagtcttggcagaagcattacgtgcaggataagcaaacctatatccagagtaagtttctattccagtgccctttccatgatggaagaggtctaatataatcaacttgccaccaggtagctggctgattaccctgaggaatggtgccatatcaagggcacagtgttggtctctgctgctggcaaatttggcactcagcagtggccatagccaggtcagcctttgtgagtggaagtccatgttgctgagcccacgtgtaacctccatccttgccaccatggccgctttgtttatgggcccattggacaatgacaggggggtggctggggaaagaggctgaaccgtgtctgcagaacaggtcatcctatccacttgattatttaaatcctcttctgctgaggtcacccattggtgagcactcacatgagatacaaatatcttgtttttgaccactcagagaggtccatccacatacctcgtccccaaatttctttctcaccaattttccaatcatgcttcttccaagtccctgaccatccagccaaaccattggctacagcccattaatcagtatataattacacatctggccatttctccttccattcaaagtgcacaaccagttgcattgctcaaagttctgcccatagggaagattttcctttacccttcatcattcttcaggggtgtcctacaaagcggctttagtgctgcagctgtccacttttgggtggtgcctgcatattgtcagaaccatttgtgaaccaggccctagtcttctcttcctctgtcaactgatcatggggaactccccatgaggccatcagtgcatgctgggggagaaaagccagggtggctggagtggagacagtgagtatttgaaccacttccttatgtaacttacttgttccttcagggcctgcttgagcccaatcacatatagaccacttccgtttgatgatccagtgctgctgtgcgtgacccactttatggccagatgggtcagaaagcatccaattcatgataggcaattcaggttgcatggtgacttgatgatccatagttaaatgttcagtttcaaccaaagcccagtaacaggccaagagctgtctctcaaaaggagagtagttatttgcagaacatgccttgctctaaaattctagaggcctctgctgtaattcatgtatgggggcctgccaaagattccaaacagcatccctatctgtcactgacacctcaggcaccactggatctgctgggtcatatggcccaagtggcagagcagcttgcacagcagcctggacctgttgcagagccttctcctcttctggaccccactcaaaactggcagcctctcaggtcacttgataaatgggctggagtaacccacccagatgaggaatgtgctgcctccaagatccaaatagacctactaggtgttgtgcctctttcttggtcatgggaggggctaaacgcagcacttattcaccttagaaggaagatctcaacagaccccacaccactggacccctagaaattttactgaggtagaagtccttgaattttagtcatatttgtttcccatcctcaggcatgcaaatatctcaccaataagtccaatgtgtttactacttcttactcactagatcaaatcagcataatgttatcaatgtaatggaccattgtgatgttttacagaagcaaaaagcaatcaaggtctctctgaataagattattacagaaagccggagagttgatatacccctgaggtaggacaataaaagtatattgctggccttgccagctgaaggcaaatttcttctggggtttatggacaggaatgaagaaaaaggcatttactaagtcaatggctgcataccaggtaccaggatatgtgttaatttgctcaagcaatgaaaccatatctggtacagcagctgcaattggagtcaccacttggttaagcttatgataatccactgtcattctccaacatccatctttcttctgcacaggctaaatgggagcattgaatagggatgtggtgggaattacaacccctgcatctttcaagtcctgatggtggcactaatgtcagcaacccctccagggatgtgatattgtttttcatttactatttttctaggtataagcagttctaatggcttccacttggccttttccttcatagtaaccctcaccctaccagtcagggaacaaatgtgggggttctgccagctactaagtatgtctatgctagttatgtattctggctctggggaaatgaccacagggtgagtctggggactcattggacccactgtaagtcagacctgagctaaaacactgttaattacctgacctccttaagcccctactttaaccggaggaccacaatgacgttttgggtcccctggaatcaatgtcacctcagagccagtgtcccatagtcccccaaatgtctagttatttccctttccccaatgcacagttaccccggtagaaggccagaggtctccttggggaaggatgagagaaagattccttgcataaattgttggtaatgtagtggagtccttcctcaagggggaccagcctccccttcattcaagggattctaggtctgtaaactggcttgtctggaaattgaggagctatgattctgtttttataattgaaattagacttagaagttttctgcttgtataaattaagtacgaatgccgtaggctctctatcaatttaacttctaagaacaccatgattaattagccagtgccagagctctacatgagtcaaactgttctgattgccactttacctctgctgtccattacggtagctatgcctaccttgcttttgacagttgagtgctgccacttggcccatgccaccttgggatccaattattcccattgtatttaaatttcatagttgggtgactgtggttcccactgttagatctgacatactgagaagagcaattacagggctcttcaaagatgcaggttttgccctcacaaatctattttgcaaggcattggtcaagggtatatattctagacctaaatctccctaagcctttgcatcccttcctctacattaaatcaagggagatcaggcatttccagctcactcacaatgggccatatcaatctgattatctaatgtcaagagatccgggtcccatagtaaatccttggccactaaggacagctggtagagatgactcttatcaaggaaagaggaacatacctggccaaccccattgtttctatagcacatagggtatcaactttgaccaaattctgggagtagtttgcctcacttcttcctcttcttctatacctgatggcaaacaacttaacatttaactctaaccctaggctgttaaattttcatgctagccaaaatgcttatctgcctttaacagcagcttgaatacttccccctaccctttcaaagatttatctcaggaacagtgcagggggacaaggccaaatcctgttttgtttctaagtacaggaagcctgaactgtactattatttagataccaccacttctgaactaactgcaagcaggagagtcaactatatcatttcaatgtgtttttataacacagcggcagattttagaggtgaaacttggaagagattgatctttttctacaaggaggtagagaatatgatgagaaatttctctatttgcactgcaagatatctttagtgaatctcttctctattcctcagctacaaacattttaactttttctctacagcaggttcatcacagtaaagatagtaagccaagtcctcaccttttctctggaaaatataggaagaaacaaaatagaggtcagataaaccagaaattgcatttaggaaacatacaaattgaccttgtaatgagcatgctgtgtagtttttttcccactatgttttctttcttaaaatcaaatctaaataatacagccatcatgtctagttaatagttgtgccattggctgggtgcagtggctcacactggtaatcctagcactttgagagaccgaagtgtgcagatcgcctgaggtcaggagtttgagaccagcctggccaacatgttgaaaccccatctctactaaaaacacaaaaattagccaacagtggtggtgtacacctttaatcccagctacttgggaagccgagagaggagaattgcttgaatccaggaggcagaggttgcagcaagtcgagattgtgccagtgcagtgcagcctggacaacagagggagactccatctcaacaataacagcaataacaacaaaaacataattgtgcccttagggggactaaaacataaagttattgaggggaaaatgtcacatcacaagcttcccttgttttacaaggacttgaggttaagtaatttcttccttccttatggttgtaaaatattgacttcagaagttgtcaaattagcctggcatggtccttgttacaagtaaataggttccttctgtggaggcactagcaatcaactttcccaaggatgaggtgctgatatcccaaggcttgcctttctccctattgaatttatctatttgtgcacctgtacacttaggcagacaatgtaatacatctatttatcgctaccaccagcgtatctgtctaaagctataactgaaggcatgtgttctcataaaagaagagaggcacattagtctagtttgatgcagcagtcacaggctttatgtagtgacttatctggagataagagtcttgactgttgttagacaccaccgaaagtcattactttgtgactgcaaggaggatgacaactcaactgagtgaaacttccagcaggttgtgcattagaacttagaacaacaaaagtgagagaagtgggggtcctggatttctattgattacaaaataagctgtttatcatcataatataagctccttatgaccagtgactaggaatttatttaatattatgcacagaagttttttaaaaacagaacattgtatgtgataaatttttgccagcaaatagatgggtgcatgcatggatggatgaatggatgcacgaatgaatggatggatggatggatggatggatggatggatggatggatggatgaatggatggatgcacaaatggatgaacgaatgcatggatggatgaatggatgaatgaatggatggatggatggatggatggatggatggatggatggatgggttcatggatgcatgaatgaatggatagatgcatgaatgaatagatggatgcatggatggatggatgcacaaatggatgaatgaatgcatggatgggtggatgggtggatgaatggatggatggatggttggatggatggatggatggatggatggatgcatagatgcacaaatggatgaatgaatgaatgcatgaatggatggatggatgggtggatggatggatggatgcatggatgcacaaatggatgaatgaatgaatgcatgaatggatggatgagtggatggatggatgcatggatggatgaatgaatggatggatgagccagactacttactttcagagttttcacgaataatataggatgctaggttactaaagttattacaaatgtgtgatttttaaggaatctacaatcagaatgatgcctacttctctggctgcttcttgtaacctccacgccttgcccacagagttctagtcacaccatagttctttctgttcttcatgcctgtttagcaccagggccgttgcacaggctgttcctcaggcccaaaagcttttctttatgatctccacatatctctttctttcctgatattcaggattcacctcacgtgttctatcactaggagtgattcttttaaccactcagtctgaagtagtgaccagattgttctccatcatggttcaatttcaattctctcctcaacatttattgtgcctttatgtatttatttgatagttttattttttctttacatttgtggctttatttatctttcattctccaataacgtttgagcttcacgattatttcccagcttatttagcactatatcctctgcatacacatccagttatagactgaatgaatggaagggaggaaaaaatcaaacattctcccataggtttaattactaaaaattccctaaattatatgcacccataaaacatttaaaacagtgtaaatttatacaaattagatatatactttgaagtgatcaaatttcctactttaaaaaggtggttgtgttgacctgtttatctgtcagccttggaaatatatcaaaggttaaataaatataatcatgttatattcttaaatcttttcggaatgaagtgaggtataaacacatgtgtgcttttatatatataaacacacatgtatatatacatgcacatatttctataattcagggatttgttggttcagactaagaactcttagttcctagttctttgctctatgatgatttagaaacctggaattttttaaactgaaagggctaatgtcttttcgtgcagtggttttcactggaggcagtaagatcatctaccgttgcacttggcattttgtgacatgtgttagttattataataaatgggagcactaaaaggcatttggtggccaggggctaggtttgctatatatctcaatgcatggaaaagccttatacctgaagaaagctttcatatctcccacaactttcaaaaatctgttcacaatcacccgagccttatacataattctgctttacttttaaacacaaagtattttgcactcagacctgccaactaaactctagccccaggtactaagctttcaaataggaactgtggcttattacattttactccctttttcctgaaaattcattaaaattcagttacgaagtctgtctttaacaatatcaaatggagcctttaaacgatgaccacaatgtatagtcctttcaaggaggaatgtctttgcccatcacatatctttctgaatttctagaagtctgttaaataaaaaggaacaaatccagacttaggtaaggagatattttgttcggaaagacttttatagtgagaggaaaaggactattgcaatacagagaatactctgaccataagatctgcaaacatctcaaaggacaggcagaaagggctcctcttttacaggaaggagtaaacaaagctagaaggagctgtctgtgggagtgtgaagaccagatggtgtggtagaacaactgattggggaatgtttctcctaggtgtcagtggactcttgagaggggccttaaaggatgagctcttctatattctgatgcttggttaaagtcaagggagagtcaaactccaggtgtctgtggagtgggaaaaccctaacaaaattttggtccagacaagtcagcagatacttttcccagattgattaaattgtataaactcagtaaatcaaaggatgatttcattttccttccacaagatcacagtaaggtttgtttgccgtttggggaagtcgcattcctaatggtcgcagtgcttgtggtatatgagcagtcagtacaaccacttgtatcatctgcatttgtggttaccaaattcgtgataattctggaagaaccaatgcaaacaggtgacgactgtgttttatcttttagtgtactaaagcagttggagaatatttcatttttaattgacttccttttgtttctccgttatattaatttaaggccttatatcagttttccacttccctagattatgtgtagagctagacaacatggctgtaaatgtaatttcaggaaaataaaggtggcattatgaaatatttgttctcaaaaagggctgtaggtcctttaaaactgcaattcctattccactgccagattattatttatgtataatgactctgaaactaacagaagttgagaaatttgcccaaagccacagagaatattaatacaattacacacatacatactcttaaattgttaaaaaatgttgacatgacaagcatggggctaggaatgcagatgaataaaaatgcctttttctgtccagtaaaaaaataacttctacacagaaatgataaaaactcaattaagaagtgactggtttagcaagcaaaaagtcctagaaaatgttatttctgataagtacattaatacaaacttttcattgctggaaactttcttgctatatttaagacatgtgaaaaagcaaaaaacaaaaacgtctagaaatctatttcttaatctgcaaaatggggataaaaatatgtacctcatagcattgtgtgactcaaacaaggtaagtgatgtgatccatgatttccaaacattaatgttcttataaattacctggaaattttgttaaaatgtagaatctgatttttaagtttctgtgggaattagaattctgcattttgaacaaaatcttcagtagttaccaataatactggttagagataattttgaatgggaaagatggaaaccccttggcacattggaaggggccagttttggttggaggtccttggcttccactcttgtactagctctttttgaagaggcattggctgtttccccacagatctcacttgcttcttttatttttagatcactcccatttcactcatttataggttttaagaatgaggggagtgattagatgaagactgtttgagggactggtaattaatactcaaaaataaatttttgaatatgcttctttcttcttcctattaaaagcataatgttctggtactttgtccacgtttaaagcagcctttctggattaatatagctactaatagaaaggggagaaaagttgctatggttagaatacatgtgttcctctgaaattcctgtgttgaagcttaaccttcacagtgatggtattaagaggtggggcctttgagtggtaattaggtcatgttgtaattaggtcatgagggctctgccttattgtagagagaggagaaggactattgcaatacagtgaatactctgaccataacatctgcaagcatctcaaagggcaggcagaaagggctcctcttttataggaaggagtaaacaaagctagaaggagctggctgtgggagtctctctctctctctctctctctctctctctatctccagacagacagatagatagatagatagatagatagatagatagatagatagacagacagacagacagacagacagacagacggatagatagatatagagagagtctcacatctcactctgtcacccagcaggctgagatgcaatggtgcaatcgttgttcactgtaacctgaaattcgtgagctcaaatgatcctcccacctcagcctcctaagtagctattttttattttttttttttagggttggggtctccctgtgttacccaggctggtttcaatctcctggtctcaagtgattctccaaccttgcccttcaaaaatgctgggattacagtcatgaaccaccatcctgagtgtttaaatacgcttctaaaagaggcttcatagaactgcctgtcccttccatctcctctgccatgtttttacaagattcatcctcttttgcccatctgccttccaccatctgatgagatgcaaccaagtgccaccttggaagcagaaagtgagccttcatcaaatatggaaaatattggcatcttgatattagacttcccagggtctagaactggagacataattttctttgcttataaactaccctgtctaaagtattttgttacagcagcaggaatagaataagatataggtattattattatattcttctggagtgacattcttattactcatatataaatattcatatctacttatctaaaacaatcacatttcttattttacaaaatagttttacagttcctcaactgggatacaaaaagcccacttttttagtgagaaaaaatgataaaatgaaatacaaaacagttctactagcctcaatattctacagatgcttcttcaatggacctaagaatggtaaacagatttttttaaagacatccaaatctaagacaccttgtatttttcagttttaccaatagatgacactagtgatacacacgcacgcacgcacacacacacacacacacacacacacacgtatataataacattccaagaaaattcttcaagtctgcagtcttggggataaaagcccaaggtaaagaaaccggtaacaccgagttgttaacatactaacattgtttttatagagtttttttattattttcatagaatttgcaaaagcatcttcaaagacagtttttgtggcagatgactgagcatctaaattatttttatcaacacacaattataacactaatcctgaaataagaaaaaatcagagggacttcatgaaaggaatatgtgaatatatatttcatcttgtaaaaattggttgcttattccttcatctataaaaccatgtggtctgaatatattgtttctcaggccctggatggagtaccaagaatgcagcctagtaaggcaagacactgcctaaaaagatggtcaaattatctagaaaaattagtaatgtaatcacactgtccaaagtccccatgacatgggagtttcaagggttgtcatgccttccagatgtgagggaccatagtttgtaacctgcaaaacaatattattgtgagtggtgcttttctttaaatgacgtctctaaaagcgattcacattcttgataccactttggaattggagatatttcatttagagcccttgaaatctgagtactagtgtgcatattttattcctgccttttctcttgttactatatgcacctaaaccgagtatttttatcataggttttttggttgtttgcttgttgttttttttttttttttttttttttttggtagagattgggatttctccatgttgcctaagctggtctagaactcctggactcaagcaatccacccatcttggcttcacacagtgctgggattacaggtgtgaaccaccatgcccagccaatttttatcataattttaaattggcaactaaccagatgctttatgttacccccccatcatcccctacaaatgactccatgtcagacacagacattaatcggtttatggagttaaatttacaaaaaggaaataggaaaaagcgacaggtgcatggcattacgtgctgtgatgtgtattaaaagagagatctcacagattgaaaggagatgtaaataccagcaggacatatttttcaaaggacacattcagaagaatcccatataaggttgcctgtcaaaggaagccattccattttaactgaatatttaagaattttatagtgacataggtttcatttggttcatatgtgatatattttattagtaaaatatatagtgcatgattatcactacccagatatgaagcaaaagttgcataaatcattgtaatttttgatgaaacaaaagaatatttcgtaatgctaatcgttattttattttttcaaaaatttgtaaaagtgagaggctaatgggaagcctaaccattggcaatgaaataaattccattttgattttcttttttaataaatattgctgcacattcctttccaggatcaagttaaactccttgctaattctttcattgaacaaaataatcgtaaagaaaactcataacatattccgatttcagcatccgtgggtattagtagtcacatgatctacctttagagacagaaagttgaaatctgatttttttaaaaaaagtaagtgcagtggcttaagtgattctatgcttttagacagtattgtcttcaataattaatttgtatagataaatgtagcgtagcatctttacatattattaaaatattgttttgagattgtcatggcaatatacatgcacaaaatatgtagactggaacaacaacacaaggtactcagtaacatcattaaatgaaaaataaggtttttggttatgtacatcctggttctactctttttaaaaaaacttaaattaattcattaagaaatatttattacagagaaaatgatatatattcaaatatgtatttatatgtattcacatatataatacataagatatatataagctatgaaacacattaattaaaataaccatcactaccctacttaacaaaaaccatatattgcagtcttagataaagttgaaaaaaattattggtaaaagtttctaagtaaatctactaacataaataattaggccttttaatttttaattatcaaaaactatatttttctttattttatttaagggtaaagattctcacagcacacatgcacaaccatgatatatatcatctaagaacttatttctgtatatggttgggcagtaagcaattctatagatgtatacacctatataacctatattaaaatatggaacatttccaacttcataaaaagttccctagggttccatttcagtcaatatacaccaagatccaaacaaaactgatcaatattccaccaatgtagcttacttatgcctgttgagaactcaatataaataggattatacaatatagactcttgtgatattgtgatataataagtaagttatatttggtctctgctcttgcttcctgacacactgcttcgaaaacccttagagagtgtcttttgtatgccaatgagctgactgttggccagggttcctgagatagcttcaggatgggggctgttcaccagaaagacggaggcatgattagagagttgagactttcaggcctaccccgcaacctccgtgaaggagagagaggctgaagatcggttgagttcatcacctatggccagggatgtaatcaattatgtctacatgataaagtcttcataaatgtccaaaaagacaagagtgtggagagctttcaggttgctgaacatgcagaggctcctggggggtggtgcaccaggagagggtatggaatcttcagctcctttcctatacctcaccctatgtatctcttccatctggctgttcatttgtatcttttctaatacactttgtaaaaaatggataaatgtaagtgtttccctgagttctgtgagccatcctagcaaattcacagacaccaaggaaggagaaaattcactggacctgcgatctgtagacagtcagaagaatgggtgacagaccattacaatagtcccttgatgtcttccaagatgccttgtgcataccaaaatccacagatgataaagcccacaattggccctgcaaaattcccagaaacaaaacgtcagccccttgcatccctctaattctgtattttttgatcctcagttatttatccaagaatatggaacactcagattctgagggcagattgtacatgtgattggtgtctgaagagagggaatcttgtgggactaagcccttaacccatgggatctgactctgacttcataaagttacttcagttctgacatgatagtggtagaattgaaatgaattattggacacttagtgtccactagagagttagttgttagtggggagaaatccatacacattttggtgagcagaagtgaactattctgtgttgagctgtgagttgtgtgtattagagtcaaaaacagtttgatgtttcccatcttttccaatggttccttttctagctcagactctcctctgtgtccaacttcactcacattatataaagtctgtgaggttttttccttctgtatgtatagcaactgtttgttccttttcatagttgagtagtatgaatatgtaatttctggtgtggagctattatgaataaagctactgttgaacctctgtgtataagtctttaaatggacatgtgttttcatttgtcttgggtaaattcttaggtgtgaaatttctgaatcctataagtgatgcgtgtttaagaaactgccaaactgtttatcaaagaccttccaccattttatgaacccctcagcaatgtgtgagagctgcagttagtctgctccaggcagtcatcaactattaccagttgactccactcccacattctactgagtgtgaaatcatatcttattgtagttttaatttgaattttcttgatgattgctgatattgagtgtctttccatgtgtttgttttcatgtttatattagttacaaaaggccattaaataattcagatacaaataaatattttgtcagaaatgttacaaatatttctttttagtatgggggatgactttagaatttcttggtgtcctttgagattagaagactttcattctcttggaggccagttttttttttttttttttaatgtttcaagcttttgtgtgtactatctttgaaaactcataacaatattttcttatatttctgtctctggaatttttataattttaccttttatgcttatatctataattcatttcaaattacttttcacgcatgatgttagtaggggttgtagtgaattgaattgtggcctcaaaaagtcctatccccagtacctgtgaatgtgacattatttggaatagggtctttgtagatataattaaggatcctgtgattagatgatcttagatttagggtgggctctaaatccaatgactggggtcactataagaaaatagagatggtgatttgagacacggacacaggcgaaggtcatgtgaaggctgagacagaaattggaattatgccttttcaagccaaggaatgtcagggttcacaagcagataccagtagctgggaaagaagtatggcatggattctccttcagagcctccaaaagaacgaaatctaccaacaccttgatttcagattttaggcccctggaactgtgagaacataactttttgccattttagaccaccagtttgtggtaatctgttgcagctagcacgcggggcgggggtgggggtggggtgtcaaggtttttttattttcacagatggcataatacagttgttctagaacacatatcgaaaagattgccatttcattgttaattattttgatgcctttgtcaaaaatcaaagtgcaggtcattcctagacttgctgattctgttccattgatctattttttgcaccaatgctatgctgtactttacattttcctgtatgtcaattctctactgtcttgataacagtagctgtataacatcttttgagatcagataagatagatctttcaagtttgttcttccttttcagatatgattttgctattctcagtgttttgtatttctatatgaatttgggaattgaattgtcaatttctacatttttttgtagaaattggactaggattttgatttaaattggttcatgtttataggtcaattggtagaaaatagatattttaaaaacattgaatcttttgaatcatgaatatagtataaatgcccatgtttttgaggttctatttttgtaaaattttcaactgcgttttccagtttttctgtacagttattgcatagcttttgccaaactgatttatgattattttatattttatattatggtaagtggtattttaaaaatttatttttttcaattatgttagtgctagcatataaaaatacagttaatatttatatatttaccatgcatcctatgactcgccaagtttatttcttagttccagcaagaaatttttgtacctatgtcaagattttataatgtggaatatcacataatctcagactaaagagttttagcagttctttttttatctctattaatttatttgcctttttggcttattgcactgaatatgatctgtagtaccatatagtataaaattagtgagaacaaatattttttatctagttttctcatattaagaaaaaaagcactcagtcttcaatcatcatgtcatgtcagctgtaattctttgaaatatgtactttatcaggctgaagatgtttacttttcttcatagtttgctaggaattttcatcataaattggtgttgactttctaactgctttttctgcatctattaagataatcataaaatgtgtatcctttgtccctgagatttaatagattttattggttgattttttaaaaacatattgaaccaaatttgtattcctttaataagcaccccttcagtcaagacgcattttccctttgtattttattgaatttaatttcctaatatcgcattgaaaatgtttgtgttcatatgggatactgaatagtaatcatatttttttcttttattgatatgtcatactagtacatattttgatggtatgtgtggtagtacatgtaggcaatgtgtaataatcagcttttaatatcagggaacttccagcctcacagcatttgttggaaagagtttcctcttctgttttctaaaatagtttgtgtaagattggtataaattctttatttaatgtttaatggattcttcaatgaaagaacgagtctggtgtttttctcataagaagccattccttttcttttttgtacttactaagttactaaacttttttattttatctaacgtttccaatttttgggatatatttcctcatgattttattttatgttcatattgatatttgtaggttttatagaaatatgctcattttatttctgatattgtcaatttgtgttttctctctttttattactcctgtttggaataataagttatcaatattatagatcaatactattggtcttatatcaatattgatataaaattgattattgatcttttcaacaaactaacatttgccttattaattttttctatagtttatttttttgttttgctattgttatttttgtttatttctgtttgtttacttttgctaaaagtacttttcagcttctgtaggtaaatacttaaatcattaattttaaatatctttttctagtattgatactttaaaaatctatattttatatttaaactgtaccacttttggataatgtataattggatctgctttacttctatctagcctatcaatttctgtctattaattgggactgtttagtttatttacactgaatataatgattgatctcattggtttaagtggacgagcttactacttgttttccatttgaccctttggtgtcttcttctcttttgcatcttttttgctttcccttgggttattctttattttagcattctatttcacttccttattgacttcgcagctatatctctttatgtttttaattggctctctatggtaaacgatatgcagccttaacttgtcggaatctgttaccccttcactcttcacatgatctgagaagcctaaggaggtttggcccagcacagggatagcccagtcctaaaccagagtctcctaccgtgaacttaagaatccctgtccattttgctcagctctcttctctcctgggttctgtcctgcagattcaagccacttcagctgcctaaactctcgtgcctgccccatcaggtcagtggaacactccagctatgcttggattccagttctctcagatgtgatcataaaattatgctcaggtagcagtgggttttcagagtgctcaccttgtcaggttcccttctcagtcatcacagtttgtgctgcatgttgaccactgcctgaattcaactgcttcatgtattttgtcaagttacaaacttttatgtggtcaatgggctagtctggtaccagttattaagttatgaccagaagtagaagtcttattagaatgtactgttttgaaaaggaaaaataccgacatgtacagcaagagcaaacttggggttggagaaagattaccgtataattataaagatcaacaattgaaaggaatttgtgtggggaggcaccacaaaaagtaacatgatttataagcagacatgtttttgtgtctcatttttcatacgtatctgtaatgtaagatggagttaaaaatcacagtcttttgagttacacaaaaacggatttgaatcacttttgcctcatataagttagatgaatatttctctctcaaatatcaatttacccatctatgaagttgaaatatttatattacctatcacaaaccttgttttgatggtcattgaaagtaattaaagtaagttatgtaatgaatctgaatgtaatgaagttatggaatgaataaaattatgtaatgaatctcaataaatgtaagttattatctttatcatctgcagtagaattattattattactgccttatcattaaggcattcttaaatactttgttacaattagatggttaataatataaaagttagttttttacaaacttaaagtaaattcttactgaagaactaggtttatatgtgggggtgtgtgtgtgtgttaactcaaaatatgcaatacccacacactaaatatacacagtcctttgagtcaatacataaatttaggtacagcataggtccaactctactctatgttctttaacttgacatttaacttgacatatgctgagtatagctttgacccacaaacgtaacattatttagatgtattttaggataagaatgtaaatgtgagtcatcatttggttatgactttatttttagttaattcttaactaaaattttaacaagtttcagaaagacattgcagtctgagtttgacctacagatcaatccgataaagatcaaatttgagcaggactttttctttccccaatttgtctgtctctagaatggttatctatgtaatacaagagaattcttagctgcactcacccaataaaataaaaattctacattaccagcagataattaatttctgttttaagatttctgggtgaataattcattattatgttcagcaacccaaatagtgacaagttaaaactttactcagtaaggacaataaaggagatagtacccattcttgtctgtcacattggtctagttggaaatagaagagctgacatcagaggcctttatagtctcagatagtaggtattatacaaaattctgatcacttccatataagattgaaatggaaatagttggaaaacagctgttttatcttgtcagatcctttaatgggacttaaggttcacactagcagaacccaagaatatttgcaagaaattgctaagtaatgaaaatttatcctgcagttccaaccagaaatgaaagtatcatgtcagtgcaattcccatcagatggtctttagataaagaatctgggcttttaacttcatttaatgaaaaaaaccttggtaatcagtcttgtagtgtaatggaacttttatctcactgtgtaagtaaattatggatggagttatacacccaggaggtgacctacatagtatactcaaaaggcaaaattaagaatggtattcgaccttgaaccaaatttcacacctgtactgaaaaattaggggtaagcttggtaaagtgctgaatgcaaacatctcccagacaagccaaagtattttattccccaaacattcctcctggatgtggatccttactaaatctcaactttaggagttcttctcttggttgggcacagtggctcaggcctgtaatcccaacactttgggagaccaaggcaggaggatcgcttgagcccaggaattcaagatgagcctgcacaatgtgacgaaaccccatctctactaaaaaaaaaaaaaatacaaaaagttagctgagcatggtggtgcttacctgtggtcccagctacactcagtcccaggctgagttgggaggatcacctgagccataggaggcagaggctgcagtgagccaagatgaccctactactgcactccagcctgggcatcagagcaaaaccctgccaaaaaaaaaaaaaaaaaaaaaaaaagacaatttttctctctttgttttctttgttttttagagaataaatctgaaactgcttgaaatgtgttaatctgcacctttggttgagaccatgaccttcggcattagaaagacaatagttcaaacatcagcttagatattactatatttgtgactctggatgatttacatacaacttttgaacctcaattatcttatatgcaaaatgggactagaacttgcctggcagagttaatttggtaaatcagtaaaataatttaaaagaaatgatattactatgcttaacacattttaaatactcaaaagtagctataattattatggatgttatgtatttcaaatgtgtaaagttttaagcaaggtactaaacctatggcccccttttcctatagttaaagtgggggttatttaaaggaaaagaaatcattatattgaagatacctgcactggtatgtctgtcacagcattattcacaatagcaaagatatagaatcaacttaagtgtccatcaacatgattggataaagaaaatgtgatatatatctatatatataggcaatgtataatatagacatatatctcatatatatataccttcaaatatatacatctacatatgccatcaaatatatacatatatataccatcaaatatatacatatatatatatataccatcaaatatatacatatatatatatagacacacacaccatggacataaaaatgaatgaaatcatatcttctgcagcaacatggatggaactggaggccattatcttaagtaaaataacttagaaacaaagagttaaatactgcatgttcttacttgtaagtgggagctaaatactgtgtacacatggatatagagagtagaataatagacactggagactcaggaaagtgggaggaggggagggagtgaggaatgagacattacctatttgatacaatgtactctattcaggtaacggttacattaacagcccagatttcaccagtaggcaatgtactcatgtaacaaaactgtacttgcatccattaaatctataaaaataaataagtcataaagtgaggatattataactatattataaagttgttgtaaaaattaaacaagttattgcatgccacgtgagggaaacagtgcttgccattttgtaagtgttccataaatgttagcttttatttcaagtgagaatatcagatagtgtttaagaagaacaccagctggctgtggaaccttcctgccaggaatttaatactagctttctcagttacttaacctctctgtgcttcagtttcctcatctgtaaaatttgtgtttcaataatagcatttcccaaacaaactacttgggaggattaagtgggctaatacatataataaactcagaatagcacctggcacatgtaaatgcatgataaatggttttgtgcttttgtatgtgagtatatgctattttttccaaaaaacaaaatagagaaaattataaagactcatataacaagcatccatatgctcagtactaaaaagtaacaagtgctaacatgttgtatcattctaacaatataaaaatatttcaatagcctttttattctgaagtgaaatattgagagttttttcctttttttctgtaacgctgccacactgaattttaaaatgcaaagtactagatattagtaaagaccatgcgtcctcgaaatcagatttcttaagtttgaattagtaaagaccatgtgtccttgaaatcagatttcttaagtttgaattctagttccactacttagtacctatgaaatcctagctgtttcctaaacttcttttatcatgctttctcaccggtaaagtgctggtgatacgttctttgcaggtttgttacaaatgaaaataaaagtaggaaaaattctcagcacagagctttgccatgtagtaagtgctcatttcactggaaaataaattcctgaaatattttcataaagtcataggagtaaaatgggatttgaaaagccagctaatctactccctttttaatgcaatttttacatctttaaatttatgaagatctcactggtatatttaatctccttgaatagtgattttttttggactattggttttaacattttcataggatgtaaagttattttaattagttgcgatcagaattaaaagatactctatttcaatttaagctctacaagggcagggttttgcttatttcgttatgtatatatgtatacgcacacacacacacacacacacacacacacacacacacacacacaatctcaagtgccacatggtagatgctcaaatattttctgagtgttaaatgaataaatgaataagaataggattgattcaaatggttatttttaactacataaatttcaaatatttgtttgaataaatatataaatgttgtatttccttctgacctgaaccccatcatatagtctatatgatttacgcatatagactataatagctaacatttatttagcatttactacatgctaagtactatcctcagcactttgccagtattagctcatttactcctcatcccagtcctgtgaggaggccattattagcctattttaaaaatggaagctgagatacaaagaactaagtaattctctcaggactaaatagccaataaatgtgaaagcatttcacaaattcagctgcaaaccttggcagtaaagcatttgcttctggctagagtccatgtcagcccctgtttgtatttaacagacaaagaagaagatactttaacaatgaatcattcttgtgagaaaaaaaaaaaaatggtggtggtagattcagttctaaaatctcaccagatgacacaatcttctacctcgtgaaatactgcagaacttaaaaagagaaaagaaaagaagacctctttcctcctacagggtaagaggattggaaaatcacttgcacttttctctttatcacttctgttgacttggaatgcaaactttcaaaaagtaacatgtgtggtgtagtgtgatttttaactaaggttggatttcagtttcactaaagagccagaaatagatagaacagaccaactaagccctgctttgttttcctaaaaatctttccttaaatataaaactgtccctggacctgctaccatctttctatgctacaccagagttcatttcaccttactctgggccaccttttaaaatgtctattaacggtcttgttttattgacacatctctgctgtctacctcgctggttcaagaagttctcaagaatggattgttttctcaatcagttttatcctagtgcttagcacagcccagaacttcttgagcattccacaaatattagtttaaccagtgaaagaaggatgacaatggtttaagaaaaagggatactgtctatactcccaacaggcacactgtactgtgggctgacaatcagaggaaaatgtgttcttctttagctataggtttaagctcttaaatgaataacaaatcaagaccttcacccacactaaagaaggcaatttcattattattattaagatgcttaacacattgttgattgttgacacttgattgaggtattctttacttgagatggccattgaagcctctaaggttgaaaactgctaaactgtgaagggaaacacaaaagataaaggtctgcattttctttgatctagtcagggtgtctgattgcaatttactctctttaaaaattttattggattgaaccttaactgagaaaagagcgataggagagagactaatattttagacattttcatattaatttagagaagtaaggcaacaatagggctgcacccacagacctttattcagttttgaatctaaattacttggggataccaatccttcttcattgtgcagctacatgcacccacacaacatatacagaaatacatattcccccctttctctctctttattcccaattgtatgttcctttaatatgctgtacttagatttttattcatatgttgtttcttctttgccagaaaagaatgcagagcctcccaagggtaagaaatactttgtttgcgtatctgtcatatacattctcagcactttcacccacttgggtttcctgtcataagcttttctttagattgagcaactaaagctcagataaatcagaagaattgcctcaaagatgcacagatcatatgttttattgttggaccccatacgagggactatcatagggtttagtgctggaccccatacaagggactatcatagggtttgttatctgtgtgaaatgagagtacatatctgtgtgaatttgatcgggttacatgcatagaatcaagttgtgtttacctatatgcctattaaacccattccagtgtaggtttcaattgagtattgagtagtgaaatctaaagaagatgcatgtgttattttctggtggaataattttattttccctttgtagattggcaaaaaaaaatgatgagaacagcttaaattttgttttggggaaaatcttttaacaaaaagttgttgtcatgaattttgttgctttatgtatctatatatctatatctatatctatatctattacttcttcaaggtcctttagggactcaaccatttttcaataacagatttttagcagtaaagttgcatatattccctatatcatcccttccatgaaaggaagtggatcctaaacaacttgggttgtaggaatgataaatccctaatgtttatgtgactcagcaggtaggggataaaggcttaatttttgaaggtatattaaggtaagtaattagggaaccattatgtgctagaacagtatatctccaaagacaatctacttctacttagctttactgacctgcccagtaaattccacagaagctgatggcgtaatccaaatccagcctattccaagaaacacatttagatataattttagttagagtcattgttgagtttgaaagagatgaacacatttcccttcatcttgaaatgttcccttttggaaaatctaattctccccaagaaaatgattggatacctaaatcatctttgaaaagtaaaatctttccctagatcttatctcatcttttaaagctcatgtgtttgtctctgacaatgctataaatgcattttcaagagaggaatttgtcctactctttaaattacttttatgaatagtcaaagtgattttcctttagtgttcaaacttcctgcagatgattagtccacacttccagaaaccaaaatatataaagacttcttcctaaattagtcatataactttatattgggcaataagtgaatactgtgcaattttgctttgtcagtaatctgacaaatactgaaaaatactgatgtatatcaagattcaacttctgagtgcccagtggctttctaaactgatcagttaaaaagttttgtcagacgcctgtagtcccagccactctggaggctgaggcaggagaagggagtgaacccgggaggcggagcttgcaatgagctgagatggcgccactgcactccagcctgggccacagagggagactccgtctcaaaaataaaaaaattaaaaaaaatttttaaaaaagttttgtcatccaatgacaacaagtttaaaaatattttaagagaagtatgaataagtaaatactgtatcagattgattataaattatagaaaagttaaaataggtcagatttttcattcttcgttttcatagtttgagattcttagattattaaaatagaaaggaactggttttctaaaggaactggattcaaagtcacttctatcttatgaacccattgtatacatgacatctgatgaagaagaccaatatgaaaagcaggggagagtctctggttgaatcagaaagctcctggccaccacaaaacttgtaacttgctccttgtcctggtggctcaagaagtttgtgaggtatagtttgaaaactactgatctagtcaaacagtactttatagagggataaaaaaaaaattctggagatgtggcatgaactgaattatttacgatcacacatagaagtgaaggcaaaatttaaaatggaaatcagcacacctttaaaacagccttctccatggaaacatccctgagaaattttcacccttactgatcattttgtcttcccatcttctcagcaaacacatcatttattggctatgtccacagtaacaatgtaatttgtgaaatgtttcaggtcagtgaagtaatctgggagaattgaaaatgctttgagggtagaactacatagcacagctttttgagtcccatagagtgcttttggtctatataaacaaacaatggataaaaggaagataagaccaacaatacagtattatacagtattgctttggaggcaatatatagcacagaacacttttatacagaacgtgacaagtgtttcaaaggaaaggatttcatgcaaaagtaaacttgataaagtctgcactaaacaaagttaaacagtaatgattgcctcctctgagttttgaatatgctaatgtatattaagaatctgcaataatgggaatttttcgaattttccatagagccttaaaaatatgatagatattgcatgcctcaagttcatggtctgcagaatatatttagtaaaatttaagaaaggaacaagactagaagtcagaagtttgatgttttgaactcaaaccctgtgccacaaaaactttggaaagcaacttctctgatcatcagtctcttcatccataaaatagcattgcctatctgagagttaaatatcaaagaagattaatataaaaggctttgcaaaaagttaagctccactgaaacataaagcatgtttattgtgttgtaagtttacaaatataactttactgattgacttgaatagaggcacaaacagcatcccttcaacaacattttcagaataaaacaatgatatttctagacaatagtgtctcaaataaaaaaccaaagttttattcaaataacttgcaattatgatagatatttttcaattttatttagtagccaggaatttgaatgttaattactttatcgtgaacttatttcttccatgaagaagctaattgaaaaattaccaaattctgtatttttgtaaacataacaaaaagatacattgagtaaatattttaaatctactcaagttacttgaagatttttctttatgagaggttacaaaaattaaacaaattcacatttctaacaaagaacaacatattctctctacaaatatatacattgtataatgtaatactaagtctaaaaagatttgcaaggcatggtggctcacacctgtaatcccagcactttgggagggcaaggtaggaggattgcttgaggccaggagttcaagaccagcctgggaaacacaacgagaccctgtatctgccaaaaaaaaaaaaaaaattgaccagccataatggcaatggcctggggttccagctactcaggaggctgaggtgggaggattgcttgaaccccagagtttgaggctgcagtgagctatgatcacgccactgcactccagcgtggaaaaaacagtaagaccctgtctcaaaaaaaaaaaaaaaaaaaaaaaaaaaaccctaggaagataaatttaagctactggttatttttaaaataattagtcacaatatttttctaaggaaataaagctcttttgaaacaactaatattctgatttactctaatttgccttgcccatgtcatcaaaacacttttgttatagaaggactacaaaaggctctcataactaatagtcttattagaaatgttttaatgcatagaagtagtcatttaaaggaaaatgaagacttttatgccaaaagaatgttgaattgatataaatggaaaaagtagaacaaggtttccctgtatttacatttggataaaatcaaagaagaatataagttccatgagggcatgcattctatctacttagtttactactgaatctcagagcccagaaaaatatttgaaatatgcaaggtgctttacacaaatacttgttcataagatccaggattgacagtgccctggtgcctgacggtggcaaacaaatatcctttctggaaaaagataacattgtccaagttttcaaattatttctacaaaccctatttcaatatttcctacacataataaaatacatccaggcagataaataaattgcaacacaagcgacaggagacacagaagcacaggtactacagataactggaaataaaaaaataacagataaatttgcaaatttgtaatgaactctcaactcagaattatatagtcaattaaaatattgttcaataaccaggttaaataaataaaatgtaatatagcaggtctaaaaaataaccaaataaaatcctataatagataaaataatctaaaccatttaatagatgttatagtggaaaagctagatttactgaaacagtatttggttaaaacaagtaatatgctgagagatatgttagaagaaactatccagaattaagacagtcaaaaggacacaatatagaaatctgagtagaaaacaataagagaggatgagaaggtctaatagaagagtcatgaatggaaagaataagaagaattaggcaaagcaatattcaataaatgttatgatctgaatgtgtccctccaaaattcatgttacaacctaagacccaatgtggtaatattaagaggtggggtcctttggaaagtgattaagtcatggtggctctgctctcgtaaacggtattagtgccctggtcaaagggcttgaggatacagcgtctgtcccttccaccatgtgaggatgggatgctggggtaagtcaccatctatggagtagagagtgagatcttaccagataatgaatctgctggcgcttagttctcggtcttcccagtctccagaactgtgagaaataaatttctattatttataaattacctggtctagggtattttgttacagcagcatggacagactaagacaatgaggttgatccttgcccaaaagaagtagaatgcataaatccacaggatcaataggcctaacaaatatggagcagtataaatggaagttagcacctagtcatattgtagcaaaatgtcagaaaaacaaatagaaacgtaaaattataaatgcactaagaaaaaaaaaagaaaataacaggatgccttcaaaggagccccaattagaatggcaataaacttctttaaaataataataaaaaacagaaaacaggcccgacacgatggctcacacctgtaatcccatcattttgggaggccaaggtgggcaggccacttgaggtcaggagttcaagaccatcctggcctatgcagtgaagccctgtctttaccaaacatatacaacattagccaggtgtgatggcatacctttgtaattccagctactcaggaggctgagagaggagaatcacttgaaccctggaggcactggttacagtgagctgagattgtgccactgcattccagcctgggtgacaaaaaaaccaaagcaacaacaaccaaaaaaacagaaaacactggaataatatcaatgcactgcaaaaaaacagaattagataatattcaatgaaaatattattcagtaatattgtttaataattttattatttaataataataattgtttaataatcaacgtgaaataaagacatctttcaaaatcaaaaattgagagaatttaccagcaaaaccccctgagtcaggttacattttccaattattgttttttaaaagtgtgactggcactgcacctgctcagaaataggatctatgttgtctcccctggaatctgaatgggctctgtgactcctcttataaataagtatggaagaggtaatactttgagacttctacaataaggtcacaaagattattctcttctctctgtctctgtctctctttcttgctttcttgaattttgcctttggaactcatgcatgctgtgaggaactccaacccaggccacatgtgggagagcacacagagaaaataacaggaaaagaaactgaagttccccatcaatagacagcatcaattccagacaagtaagaaaacaagacttcaaagattccagtccacagccttttaactcttccaaccaaggctccaaacctgtggagtaaagattaattatccccctataccctatctacatttccaacacacataaactatgagagacaatataaacaacttagtgttgagacttgtaatgtaatcacagtacctgaaactaattttggtaccaagagtggggtcctatgtaacaaagactttaaaaagccacaatgacaatgaatgggacagatggaagttgaaagggctttgaacaggctgagagtggaagcctgatggagacgatcagtgagagattatttaaaaaaataataaaggaggaaaatttgacacttgaagaaagggaatccttgttaacatactggcaaaaagtttaccgacactacactcacagtaaagtagtaagtagaaaatgtacttagtgaaatggataatttatttaaggagatttctgggtagagtgtagaaatgcttcctggcttctttttgctgcttataataaaatgctagacaagagaaataaacaggaaggcctgttaagtagagaggatccaagacttgcattcaaaaataaaaccgtctctctttccaacatccaagattctcaaaaaagaaagtatttcagagcaaagcaatattctttataaagactgcaagtatatgaaatggtgcctatgagaattgtagagtgaaacataagttcctttatggatcttaaagacatgctatattttttagaatttcatttaaaaaataaatctcaaattcaaagttaataaaacataagggttgacttttactgttagaataatatttttccaatgcccccaaattggattgaccaataattttctattcatgcaatatagcatttagcttcttgcaatatgctggggtcttcattgaccacttaataaccaggaagccaaattaataatctacagcataaaatgaatataatttctcaaatcaagagtactgtatttcattaaatccggccattgatagatatatcttttatataaaactaaaaaaactgacaaataaactatgacacaatactcccttattttataaaatcttattactaaaatttgtatttatactcattacattcaattatttaaggttttttaggtttttttcttataaataatttccgtgtggtatgtaaaaagataaatacttttgaaatggttaaagtacttctaaaacatcttaaaattaacttctaattatcttgattccctttatatctcagagctgttgatgtcattgttttcccacaccatagtttcttttgtgccatccaagacattattggtgcagcatttctaaaagattcctccactgttgtctgtaggattttcttctaagctctgacatctcatccattctgcaaattttactgctttcctgattttaccagatgataacaatagaaggttttcaggaaatatctaaaacacatagttctcaagtgattcttaggcgatttagtattttaaatgtcaaaaggtcacaggtatccagtgatgccacaaataataatgacaaaatttatatgtgtgcaagccactacttcatggatgccttctggccaaaaataattttaagatgttctgattgtgagctatctctagattaagatgttaaattatgacaaaatatgcatgctagaatcaataaaggatgatattttgggtaaaactatatgtcacttaatagcatgtgttgtcctaggcctagagtactttatttttatttttttatttttattttattttattttattacattatattttatttttttttgagacggagtctcgccctgtcgcccaggctggagtgcagtggcgcgatctcggctccctgcgagctccgcctcccgggttcacatcattctcccgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagtctagagtactttaataagctcacttagattttttgtggatccaagagtgacatccagtaggatataaatgaattagattttccctttcccaaaggcaacctgaaagttatattagagaccctataaagtgaagaattggaccctgcctacctacagtggtttaatttaatcagaatcacaagcccaagctagttggttatttatttctgctgcctaagctctagataatataaatgaaattttatatggtgccagtgctcctctgatcaacatagctttgagtagcaatctgtttggtgtgagaaaattagtaaaattttgataaatatcagggctctgcaagttgaatctgatggtatcaagcaagtctaataataggatggggtattaccattcataggttttcaagactttcataagctcatttgtatttccacagttccaaatttcctggagaataaacacaagagttacaacttgatgacagatccctatgcattccaaatggccacaaacaagtactctattcatggaaattttgctaaccctggatatttacactggttttaaaccaagttcagtgttccaaataacaagtgctccagaattatgagagtcaaacattctgtttaaaaaatttgtttagctagtatttgggcataaaagtactttttttgctaagagatatagaatgtatttgtactgatagctcactatttatgaaatgtatcatttatatctgctatctgctatttaggcccatctatatgtatatgattatttgcaatctgcaaatagttataattaaatgtagccaagcaaaagcatgatacctgcaaatttctctccaaactgagtataattgctgctgatcaactagttatcaaatgtcttttttctgcttgctttatatcagtaattttaatatgaacgtattgatatttaaagcatcatcagagtagtatgtttctttctgttaaactttgctatgtgttttagtgtttggatagaatcagtgagtgaaattttgcaggcgtgtgtttaacatgagaggaggcaagataaagtatactgctttgaccaggtctgcaagtaatgtattaatagtatttacattcctgacctcaaaaatcagttcatgtaaatttctatcttgttcaacatattggcaaaggcaagactgccagaaagacaatttaaaatgccaatgtggtacaaagtaagagggatgtccaggagagtttggagtgagtgaggctttcaaatctgggcccgtggcggaaaatgggggaaaaaagtgcatgttctctggctttgttaccaaagtaggagggtagcattcagatgttgctctgtccaatagcagggtacagtggtaaacgctctgagcttaagatttagaggactcagagagagaggttaagaggctggcccaaggtaactaacataaaagaagcaggatttgcagtttattcttatgttttgttttgttttttactctataaaaacaaccactattataggtaatcttgtgtatcagaaatatatatatatatatatatatatataattaaatctccatagatagctcttctatggtcttgaattcacttgaatgtgcatgacatcatccataaaacttagtggtttaaactaataagcatttgtgattgctttgacatctatgtgtcagctgagtggttctgctgatctgagccaggtttggcccatcttggctgggcttcctcatgcatctgtgctcagctggcaggtgaacagggcagtgggtgtccctttatggacctcacccatgtctggcacttggctggcagtcacctggcacaacagtacacaataggccctgtgtctttcattgtccagcagagtatactgagctcgtttttatgtttatggcaagtattgagagtgagaggcaatgtgcaggcccttggaactggcatctttcacgtccatcacaatcttttagacaaagcaattcatgcaaccaatcccgattcagggggtagaaaaaacatactctcatcatgatgggaagagctataaagtcacattgcaaatggcttgaatacaaaaaggacatatttttaattattctatcaaagcttgaataagaatgctttagaaatctcagataaaatatttcaaaagaggtcacagtttagctgaaagtaagagttaaacaaatgttataaatgcaacaattaaaaaaggtgaatgttttggctcatgtggagataaaggagtagagtactaatagtgtaaataattgaagtttcatgaaagcaattttatgtagaagtacttactttaatttatatgacgtgttaatggttgaaaaagtgagatgaagaaattacacttatttagtgaactgattaattctaaaatattattgtaacatagtttatcttctgcttgcaaaatttctatatttggctactgagcctaaagtattccaatgtagattcatgtgaaaggttctacatatcagacaaacccaattaagaatgtgatagggatatagcatcacagagcagtttattacaaggttttttaaaagaaagtaattgttaatgtaactatttgttttatttttcttctaatatccaagtacataagaaaataacaaaaaagactgattgcatcaatacaaaaataaaaacagatggtcatgaacttttacttacaattattcaataaccttagaaaaatataaagatcattctcctgctttgaaagaatatgaaaggtcatctggttgatctttctgactttagatggaatattcttctcttaacacacagttctatatttagcaacaacatttttagaccagtgtacacaaaacaacaagagattagtcatttcaaaaaatgaggttaaaaaaaccttgattttatactgcaattagtatgtccctgcccccaccttgaacttattctgtacctccattctgcatctccattctttcgagtgcattgtagcctctgattatgttacccagggacaagacacttaacctcactggaatcgttttctactttgatgagcaggagacttatatactgttaaagttggatgctgtattacatgtgattacactaaaaaccagaacactgtaaatgttaagtgtggattttgcagacacattggtctttaaatcctttttctgtactttctagttaaatctcattggtcaatatttgagctttattagacttgatgtctacatatgaggcaagcagataatcacattaactcccttagttcccatgacaagtaactaagaaaatgcattaaatgagtcccttgcacatttccaatgtgtggcaagtgcttccatggtagtcataaaatgaataaaaaaatggttagacacatcagtttttcctaacttatttgatatagatgataagctaacgattattaacaaaagaagataaaagactgcggtaccaagctctgagctgaatagagcatcggtcactggattactccaatcaccttcaggttgcgtaagcttaggaccacaacagatgcacattggactcgatattattcaatcaccacaaacagaaacacccacaatctctttggaagaaaatttttgattaattcatttagtgttttatttaatattataattacttaattgttaatgactttcctgctctacctaaaaagtttccatttaaaggttttctttctcatttattaagaatattctaaaatctcttttttttcttatctctcaattttctccaaacaacaaaattgtccagtatatccatttttccatagctatctttagctattttaactctgaacacatcagttgaactgtggaataatttacatttgttcaacaataaacaaacatatagaaagctgatagatcaatgtttccctaggcttacagtgcaattatttaatctctacatggtataaagtcacccatatttatttttctcctgttcatatatttttatgtccaggacagtaatttccttacaggagagttcctaatgtttttgtttgtttgcttttatcaaagcaaaaataaaacatggagccctaaattgttttcaggagtcaacaggctttgttggggcgagtatgtatgcataccagaggaagtaatgaaatcatttactctattcactttcctcacaagaaacctgccaagaaaacgcgagtaaagacacagatcgatttttaaacctggaaaggacctaagaacttctctaggtcaatctttttattacatcattgaagaaactgaggcatagagtaagccactgtgcaaggacgcaaaactatggaaaaatctggataggaatataggcttttcttcttcctaattcagcatgctgttctctacatcatggtaagaggacggaagggagatctatagaaaactttggtccctatgtggttctgcaaccaagcatctggtgatagacctggggctgctatgggcaaaagccatccgtggaaaaaatgatagacacagagtggatgagagtgagaatacctggagcttgccaggcacctctgtagttgctcaaggactccatctgactatgacaacctacagaatgtaatggatgtaccacttcactcactctttccaaatcgcatgaaagttcatcttttgaccaaatctaacctgtcaccgtagagtgaataggattctgggaaatagagtaaagtttagctattctctcccagtaaaaccaccccagctggtaacctctgatccattctaaatgtaaaattcttcaggcatcactctgctaaatttattattttagaacagcaaagttctaaggtgaatagagtgaaatacaactttttgaaacctttttaaatttctacattgtaatattattgtgagccttgatgaacctcagtttctttcttcaatatctgtcatcaaccaaacctttaaaaaaacatgtaatactccttcctgtcaaaatgttcataaaacagctatttggatctctctttctctctctctctgtctctctctctccttgtgtgtctctctctctttctctcttgttccatctctccctctcttcatctctttccattactctctccatagctagctagctagttagctagttaggatagatagatgatagatagatagatagatagatagatagatagatagatagatagatagatagatagatagataattgagagaaagatagatggagaaatagttttaaacagcttcattacataaaagaatattaaagttctgaaactagatttttttttttttgtaaatttcaaaagaatgtagacttctctttttctttagtcaaatttttggtgctttcctggaagctaaaacagcactggtgctgaaagggtggccattgcgatcatactgtcttccccatacattttctcaagtgtgttgaaccttcccacagatgaaatgaactcttaaagggcaagcactgtttgtagtgctaccaagaggaaaggttccttctataaaacagtaccatttatcagacccactcaacactaagataaaggatagggatatggaagcaattgtcctggtcatctgaggaaataaccaatggatactttaggctaaagcatgtttggcctgaactacccaataatgacctcctagctccatgtggatatgtttgaatgtccacttaagtttatgtctctcttcactttttcctctgtttgtccaaatacaatatcaagatcatccccaggtgatttttttattatactctgcttgggtctttcagggagtacactcctaggtagaaccaagttgcctctgtccgggcaacggaagcctctgcttccaattatttctgccctgcaggcacttcttataaaggagctttctttgccaagttctagttattatttcctgaggcctttttttccctttccaagatacctcttgagagcaaacttctgatagaactgcaactttgtgacactagatagtacaagaatcattattttggctttttcactttctgactttttacacacctataattacatgctttgcagtctttccattcagataaaagcagtattctttaagacttttttttcctttcctttatttctgtggttatgattggaaagagaggcttccaggaacctccttgaaagtaccaacatatttcattcatttttaaagttctctttaatttattttttttctttcaactagttataatctgaatattattataaccataatatggtggcaaaactgtcaccctctttgcacgttcacagctgcacttaaagagacacttatgataccatggatagaatcacacgttgttcttactcgtgtgtctaaacaaagttagaaatattgctgaaaatcgtcaaagggacgtaggttctggatatgccaacattttgcatgattctgaaaatactttatagttgtgtctttcaggcgaatcaatcagaactttagtcgtaatcacaacataatcagcgaatccagtatttccctttgggtcatatagaaggaacatgtatctgatcagtataccaataaaaatcggattagttctgagattctccttatgattgagaatctacttcatctcaaaactgctttacaggtctgacctgctacagttcaggttaatagcacacatgtgtgacttaaaattacttaattgaagctacagatgtgtttaatttagattccatagtaacgtgtgtgtgcatgtgttggcatgcacacatttgtgcaatcaaaaagaccatctaattacaaaataaagtaaaaattgaggattttaattatgcataaatatattacagatagttgtacggcttcaagtcaattgaaaagaccattgggacgttaataattaaagtgtggatttagaagctttattcactgcttatgctacttaaatataattttcttttaactttaaataaagggaaaattgattctgattaaacaacaaaatggaaccattgatgttaactaatgccatctattgcaagccagatttttctagcgtaatctttttttttggaagacaatatgagatggagatcacagggaaaacttgacgaagcttgcaagataatattccaattagaaatacagaaacatcttgtttgaaaaaacattagcacacagaagccttcatattcttcaaacacacttatatacctttactcaattcagaaaaataaaactgtaagcttgagcaatatgtatagacatcacccttgtgttacatttttaaccttgcaaattctatttgcgttggaattcagttttccatttgtaaattggaatcactgagtcagttagcttacttgctatagatatccaaggataccaagctacaatatacatctgaagacttactaaaacacaagcaaccttagtgagcaggatatcagtgggatataatatagtgggttttggaaccacattcaccagcattcagagcctgtctctgttatgatttagctaagtcaccaattctgagtctcagtgcccatgtctataaaataaagataaccatatttaaggttttgtaacaattcagcgaggtcacctaggttacagactttttactgaaactggcatatagaagttaatgttatggttcatactatcatatatttcaaccttctgttaccaatgaggtaatatgtgacttatctcgaaccacgctattctagcatgtttgggaaagaaaacgggttttcttattctcttttcctgcagtgactaaaagaaaaaagtattgtaatttttgagaaacatctctgtgaaaaatatgtgatctagaagatgtctctgggtacatggatcaatgagccatgaaaaaaatgggaaaataaaattgtcaattttttgataattcaatctgtttgggtaggacctttcctgctaatagcttcccagtgggtaattctttatcggctttttgtcttatagttaaaatggcacaagtggtcccagtggctgttggcagaataatctgacattttatgttattggtttcaaattcccaccaaaaacacctccccatgaccagaagatttagtatagtccatagacagccaatttccaaatttttggctcaacgtagaagggttttgtcccattaaaaaatatcccccatctattccttgattgataggattcaactgctccacttattttgccatttgaccagacttaaatctaatagatacggatcataactaacagccagcctgccaacaaatgattcaagaatgctgtatggataatttttttctttagtaaaatcaaaatcaactaagccacctgctgaatgatattgctggaagcattataaacaccatgaccaagaaattcaactgcaacctcttctatgacaatcactaacaatgttcctcatagcttgaagctgaactgaacagaagcagaatgtataaaacaggcatgttttagtcattgatacctagatgggaggatctcactttcttgttctataaatacagcaatgctacttggctgtaggtaaataataaagtaaacaaaattatgttcttcatacccagagccttgagttcaagtgctggctatgctcctcattagccagttgtgggatcttaagtatgggaccacagtatgttgggattgcaaaatgagaaaagtcagaataaattacttttaagtttcttttattctaagttttaaagattgtccttttctacccccagtgcaggaacacagaagtctcaaatttccacttacaacattataataaacttacttattcctttattttctttgtttaatttggttattcaaaaaacttgcattggatatctgttatatgtcaggcacagggcaaaattctgaggatgaaacaacagtccacattattaggaaacaaatcatagcaatgagtcaagctgtgatcctctgtgatatttcttgcttcattcaggtcactgctttcacttatctaaagtggcaattatttggctacgcaattcatgctattgcaggttgcaggttgcccttggttccttatgaaatacaattcttgacagtagttatggcgaggagttggttctttttattatttcaaaaacatttacctttttttttttttttttgagacagagtctctcttttacccaggccggagtgcagtggcgtgatctcagctactgcaacctcaacctccccagttcaagccattctcttacctcagcctcacgagtagctgagactacaggcaaaacccaccacgcctggctaatttttgtgatttttgtagagacaggatttcgccatttggccaggcttgtctggagctcctgacatcaagtaatccacctgcctttgcctcccaaagtgctgagattacaggtgtgaaccactgcgcctgtccaggttttacttttattaaagaagcacaaactgaatcaaaaaagtaaagtttaaggtgaaattaaattaattctctgatgtttcaattatattataggctgataaaaatttcagaatgtggccaggtgcggtgacttacacctgtaatcccagcactttgggagtccaaggtgggcagatcacgaggtcaggagtttgagaccagcctgaccaacatggagaagccccatctctactaaaaatacaaaaattagccaggtatggtggtgcacacctgtaatcccagctactcaagaggatgagggagaatcgcttgaacccaggaggtggaggttgcggtgaaccgagatcgcaccactgcactccagcctggacgacagagggagactccgtctcaaataaataaataaaaaaaaaaataaataaaaataaaattcagaatgttaggtaaaaatgattttgatttaaaaaaggaaatatgttaacaattagttaataaattgtagtttatttggtagaagatatattaagacatgggatccaaaatgtaattagactatgattgaataaggtaatatttaacctccctttaaacttaaaatgacaagattcttcataactttgagttgcttctttaggtttcagagtttaaaattcaaacttccacttttggacccatatgggatctcaagtttgatacatgatacccagagccgattttctttcttctctttctttcttttcttttttctttctttctccttccttccttccttccttccttccttccttccttccttccttccttcctccctccctccctgcctccctccctctctctctttctttctctttctttctttctttcaaataggctggatggacaagagttatgaaaattctggattttttaaaatagtttgtttttgaaataaaaatgtcaaaagacaaaaaatatacagtcaagacctataggtattgtattattgtttgtttgttttttagtattcagttggaaggcaggaattcctgaagatatactaaacttccttctgaaatattcggaagaaaataaaaagatataactgtagaaaacataaactcaaacatgacattatctgaattctgcactattatattaattgcaaaatgttccctatactccatcatttctgtgcattgtcctcaatttatatacaaggaaactgagacttaaggaccagaaataatccaaaagaaatgaacgtcagtgtggcttagtgaagactcatattttttaaccttgagaagaatagaagctagaacaggaagaactcaaagaacagttgtggtcatcacaatcaaactcattgttcccagaaatatatttgacaaaacttgagagtagtatttattctggttttattatatcaaattgcttttttctcaaagactttataacatgatgtgtattggaattacaagtaagaatagttctgaatatatatttgtttattcacccatttttgcattcaacacctatttcttgaatacattcctgtctcaagaatctaaaaatttaagatacagagggaaaccagataacatagttgtttccctcaaagagtttacagggtggtggagaagacaaatgttagacatataagcccagtgaagtgtgatacacactataatcacataatatgtaagcatattacataatagaattaagtgattgtagaaagttcctaaaagaagtggtatttaagctaagttctgaaggacaaatatgcattaattagaaaccaaaaggtaatgattgagtgtgattgatgacattgaactcaatgaaatattaatgtgttcaagtgccaacagctacatttgctacagtataaagatatgattaacacttgacctactttatttactgaactcttgaacttcttaaagtcaatccaaagtggtcctttaacataattgttttcaaaccttacagggaattgttgccatttccagatgtcagtgattttcagaaagtgcttcatgttgaaatgaaaatctactcaattacatactaaatcacatttcacgagaaaacacattacataactaaatgaaaataattatgtacccttcaatgagactatgaattttcttaacaatattaagtttttaaaaaacattttgatgatacaaaaattacattcttaaatataagtaagtaaaggtagtcagaataccatggaaaatagtcttctctatttaaaattcttgtaatatgaattgaacacattagattttataatggactctagtaattaaaaaattgatctaactataaacatatcgatttcctaataaaaatataaacctaaagccccattatatcatataaatatgaaataacttctagtaatatggtagactgagttggtgtagaatgacttctcccctgacccacaactacccaataacagtagatagaaattctggataacatgtaacacaagcagattaatagtgtcatcatccatctgcaaagaggagggaatggagaaggtagggggaaagaaaccttcaagatgtcagctacaaaaatattttttccaagtggcaaaatgttaccaatgttctagcttctcacatagttgggggtaaggttgagggtggacgtggtggggaggaaaccattaaaaatgagcttatagctaaaatcacaaccaaagttgtgatctactctgaggcataattaacaggatcaagaagtaggagaatcaacatatagaaaaatacaaacatgatacttttttatatgtgtcagaagttactaaaaatcaagaaagttttatgactagtaattatttatttttaattttatttttattatactttaagttcagggatacatgtgcagaatgtgcaggtttgttacataggaatacatgtgccacggtggttggctgcacccaccaacccgtcatctaggttttaagcctcgcatgcattaggcgtttgtcccagtgctgttccaccccgtgccccacatctcccaacaggcccctttgtgtgatgttccccttcctgtgtccatgtgttctcattgttcaactcccacttacgtgtcagaacatgcggtgtttagttttctgttcctgtgttagttggctgagaatgatggtttccagcttcatccatgtccctgcaaaggacatgaactcattcttttttatggctgcaaagtattccatggtgtttatgtcccacattttctttatccgttctgtcattgatgggcatttggtttggttccaggtctttgctattgtaaatagtgttgcagtaaacatacatgtgcatgtgtctttatagtagaacgattaataatcctttgggtatacacccagtaatgggattgctgggtcaaacggtatttctggttctaggtccttgaggaatcatcacactgtcttccacaatggttgaactaatttacactcccaccaagagtgtaaaaacgttcctatttctccacatcctctccagcatgtgtttcctgactttttaatgaccaccgttctaacaggtgtgagatggtatctcattgtggttttgatttgcatttctctaatgaccagtgatgacgaactttttttcatatgtttgttggccgcataaatgtcttcttttgagaagtgtctgttcaaatccttggcccactttttgatggggttgtttgtttctttcttgtaaatgtgtttgagttccttgtagattctggatattagccctttgtcagatggatagattgcaaaatatttctcccattctgtaggttgcctgttcactctgatgacagcttcttttgctgtgcagaagctttttagtttgattagatcccatttgtcaatcttggcttttgttgccattgcttttggtgttttagttatgaagtctttgtccatgcctatgtcctgaatgatatcacctaggttttcttctagggttttcatggttttaggtcttacatttaagccttcaatccatcttgagttaatttttgtataagaggtaaggaagaggtccggtttcagttttctgtatatggctagccagattttacaacaccattgattaaatagggaatcctttccccattgcttgtttttgtcaggtttgtcaaagatcagatggttgtagatgtgtggtgttatttctgaggcctctgttctgttccattggtctatatatctgttttggtaccagtgccttgctgttttggttactgtagccttgtaggatagtttgaagtcaggtaacatgatgcctccagctttgttctttttgcttaggattgtcttggctatgtgggctcttttttgattccatgtgaaatttaaagtagtttttttttattctgtgaagaaagttaatagtagcttgatggggatagcattgaatctatacattactttgggcagtatggacattttcacaatagcaattctttctatccatgagcataagatgtttttccatttgtttgtatcctctcttatttccttgagcagtggtttatagttctccttgaagagatccttcacatctcttctaagttgtattcctaggtatttgtagcaattatgaatgggagttaattcatgatttggtctctgtttgtgtattattggtgtataggaatgcttgtgatgtttgcacattgattttgtctcctgagactttgctgaagttgcttatcagcttcaggagttttgggattgaggtgatgggtttttctaaatatatagtcatgtcatctgcaaacagagacaatttgacttcctctcttccaatttgaatgccctttatttctttctcttgcctggttgccctggcaagcacttccaatgctatgttgaataggagtggtgagagagggcattcttttcttgtgctggttttcaaagggaatgcttccagcttttgcccaatcagtatgaaattggctctttgtcataagtagctcttattattttgatataagttccatcaatacctagtttattgagtttttagttgttgagtttgatcaaaggccttttctgcatgtattgagataatcatgtagtttttattattggttctgtctatgtgatgggatatgtttattaatttgcatatgttgaaccaccctgcatcccagggatgaaggcagcttgatcgtggtggataagctttttgatgtgctgctggattctgtttgccagtattttattaagaattttcgcatggatattcatcagggatattggcctgaaattcttttttttgttacacctctgtcaggttctggtatcagcatgatgctggcctcataaaatgaggtagggaggaatccctttctttctactgttatagtttcagaaggaatggtaccagcacctccttgtacctgtggtaaaattcggctgtgaatccatctggtcctgggcttttttttggttggtaggttattaattactgcctcaatttcagaacttgttattggtatattcagggattcagcttcttccttgtttagtcttgagagggcgtatgtgtccaggaatttatccatttcttctagattttctagtttatttgcatagaggtgtttctattattctgtgatggtagtttgtatttctgtaggatcagtggtgatatcccctttatcatttttttattgtctatttgattcttctcttttttcttctttattagtctggctagcagtctattttgttaatcttttcaaaaaaccagctcctggattcatttattttttgaaggattttttgtgtctctatctccttcagctctgctctgatcttagttatttcttgtctactgctagcttttgaatttgtttgctcttgcttctctagttcttttaattgtgatgttagggtgtcgattttagatccttcccactttctgatgtgggcatttagtactctaaatttccctctaaacactgctttaactgtgccccagagattctggtaccttgtgtcttagttctcatcgatttcaaagaacttatttattctaaattaattttgttgtttacccggtagtcattcaggagcaggttgttcagttttcatgtagttgtgaggttttgagcgagtagatgcagtttcttcatagtgtcattggtctttatattttggtatgtctttgcagtggctgacaccagtttttcctttccatatttagtgctcccttcaggagctcttggaaggcaggcctggtggtgacaaaatcccgcagcatctgcttgtctgtaaaagattttatttctccttcacttaaaagcttagtttggctggatatgaaattcttggttgaaaattattttctttaagaatgttgaatattggcctcctctctcttgtggcttgtggggtttctgcagagatttgctgttagtctgatgggcttctttttataggtaacctgacctttttctctggctctccttaacattttttccttcatttcaaccttggtgaatctgacaattatgtgtcttgctgttgctcttctcaaggagtatcttagtggtgttctctgtatttcctgaatttgaatgttggcctatcttgctaggttggggaagttctcctcaataatatcctgaagtgtgttttccaacttggttccattctctccgtcactttcaggtgcaccagtgaatcgtaggtttggtcttttcacatagtcccacatttcttgaaggttttgttcattccttttcattcttttttctctaatcttgtcttcacgctttatttcattaagttggtcttcaatttctgatatcctttcttctgcttgatcagtttggctattgatcgtatgtatgcctcatgaaattcttgtgctgtgattttcagctccatcaggttatttgtatttttctctgaactggtttttctagttagcagttcctgtaatcttttttcaaggttcttagcttccttgcattgggttagaacatgctactttggaggagtttgttattacccaccttttgaagcctacttctgtcaattcgtccaactcattctccatccagttttgtgcccttgctggcgaggagttgtgatcctttggaggaaaaaaagacactctggcttttggaactttctgcatatttgtgctggtttttcctcattttcatggatttatctagctttgttctttgatgatgatgacctttgggtggggtttttgcatggatgtcctttttgttgatgttgatgttattgctttatgtatgttagttttccttccaacaggcccctcttctgcaggtcagctggagtttgctggaggtccaccccagaccctatttgcctgggtatcagcagcggaggctgcaaaatagcaaagattactgcctgcttcttctggaagcttcaccccagaggggcaccagcctgttggcagccagagctctcctgtatgatgtttctgttgaccccttctgggagttttctcccagtcaggaggcatgggggtcagggacccatttgaggagccagtctgtcccttagcagagctcgagtgctctgctgggagatttgctgctctcttcagagctggcaggcaggaatgcttaagtctgctaaagctgtgcccatagccgccccttcctccaggtgctctgtcccaggaagatgggggttttatctataagcccctgactggggatactgcctttctttcagagatgccctgctcagagaggaggaatctagggaggctgtcaagttccagtggctttgcagcactgtgctgggttccacccagtctgaacttcctggttgctttgtttacactgtgagggaaaaactgcctactcaagcctcagtaatggcagatacccctctccccaccaagcttgagcatcccaggtggacttcagactgctgtgctggcagcgagaatatcaagccagtggatcttagcttgtggggctccatgagtgtgggaccccctgcctgaccaagaccgcttggctccctagcttcagccccctttccaggggagtgaacggttggttttgtctcgctggggttccaggagccactcgggtatgaaaaaaacttttgcagctagcttagtgttgcacaaacagtgcccagttttgtgcttgaaacccaggactctggtagtgtaggcaccctagggaatcttctggtctgtgggttgcaaaaaccgtgggaaaagcatagtatctgggccagattgcaccattccttatggcacaatccctcacagcttcccttggataggagagggagttccttggccccttgcactttctggatgaggtgacacccccaccctgcttttactcaccatccatgggctacacccactgtctaaccagtcccagtgagatgaaccaggtacctcagttggaaatgcagtaatcacctgccttctgcattggtctcactgggagctgcagactgaagttgttcctatttgaccatcttgccagattctcccccatgactagcaattgtagtatcataaaatattagcttgaaatgagcaagttaatacacttggtatgctgcccttactttaagaaaatgataaagaagtaaattgacaaggtgattttgtttttcagttttgatcttacccagtgccacctctcaaaatatgtatacatgtacttattttattgttttgattgattgtgaagaatcagtttttaaccaaaataatatgattttattaaatgacactttctcacaaaagccatttgaagcaatgcagaatgggatttttctctgaacatgtcaagttctgggagaacatttttagtgtaataggagaaaactatattttatctattcaattctgtcatgcaaattggaaaagaacttctgaaggaattacataggacttcaaaatataatactttcagcaagttaattgcatgaattaataacaacattttcagacaatcaaatcagcccactccactatgatataagcacgaaaagcatggctccagttttgtcatttgtgtgaccaacatataacactgattaaagcttgtcttggacaaatgaatttcagttattcaaatgaacagatataacagcaatgtatattaatttgaaaatgtaatttcacaagaaaatataacgaatatttttcaaaaaactacaagtgagagcttttctatgagaaacccagttagctttattattagatagtagctgttggtaatcacactgtttacacagctgaggaaggccatggattcagtgctttgctattaataacattaatagttgcactaagccctcgtcaaatgtcagacctttctcaggcttccctgtgatgcaaaagtgaagatgtgataataaaaatgttaatgctggtgatcattgtgaataagtccatatatcttcagaatgatgattttgcgcatatatgctttggtttgaatttcctctgaagcagatcctgagacaagaagttaagagcaaataatttctctgacaggtgcaaatgacattggtaaaattataggaaagtgttacagggaagagaagcagcaaaaagtgtgataacaagccaggaaccgtatgaatatctgtagctctgttctacaggaagactcttaaccatgatgaaaagcacagacctcagaattacttcacaagcaggccaaggaagccagataattatacatacatttcctagaaccattgattgagaccttctctcagaggttattaataccctggcacttccatcctacaataaaacatggataaacagctttctatggctctgtaaaatgccttaggctcaaatatgtatttactggcaattggaacttggtggaaacacaccaaaatagtgagttctgaggaacatgggtggggcactgagaacatctgctgcaactgacaaatgatttagctaattaaacaatgcattttaatgagttatctatgattaattccaaataaaagtagcatcgtatgaaatcagctcacaattgtttacacattcttttgctgattagcaacatcttaatgatatagtgttgaaaagaatgcttttatatatattgaaattctgcatattagaattgataatagtaagccatcctgcactttttaatttatatacgactactcttgggctccaaggaaccaaaactccaactgaaggagcttaaaccataagaagattaactattttgtataagaagtcctaacacgtgatggataccgaaatggttggctcagcaactataacaatatgagctaagattcatgagattcattgcctctttagcaggtggactttggcccttaggacagacatacccatgattacaaggtaggttttggagacccaaaacttacgactgaagcaatgcacaatagaagaaaggtttatttctatctaggtatctctttaggaatgaagaagttttgttcaacatcaccaagcacaacatttgtttatattcattttacataatttacttttaatactgatataactaatatatgacacaatttgccattttgaagtgtacaattaaaaaattgttggtatattcacaagattgtgcaaccacctaattccagaacattttcatcatcccacaaaaaaacacaatacccattagcatttacttctaatctactcacccgtcctctgtaactactatctacattatgagtctatgggtttgtttattttgggaatttcatagaaatgaagtcatataatacgtggccttttgtttctgtcttctgtcacttagcgtaatgttttcaaggttcattcatgttgtagcatgcatcggtgtttcattcctttttacgacaaagtaatattttattgtagtagtaatagcagtagggagaagatgagaaggatgaattataatagtaatagtagtaagtagtagcaacagcagtagtaatagcattcaagaccacagttagtttattcattcatctgtttatgaacatttgggttgtttccatatttatctattataaattatgctactgaacatttttgtaaagtttgtatgtgaacatacgtttttagttctcttgcatatgcatatgcagaattcaaattctttattatatggtaactctgtgcttaagttttgaggaactgccaagctgttttccactgtggctgcaccatggtacattctcaccagcaataaatgagaattattccattttctccatatccttggcagaatttgttattgtctgtttttctttgaatatagctattccatatggatatgaaatggtgtgacattgtggttttgatttgcatttccctaattactagtgatgttgagcaacttttcctatatttattgaacatgtacatatgaattttagtgaaatttctattaattgcttccccatattttaattgggttatctttttattgttgatttgcaagtgctctttatatattctagatacaaaacatttatcagatatatgatttgcaattattttctcccattcaagcattctattttaactttcctaacagtattatttgaaacacaaaagctttagatattggtaaaatcctattaatgtacatttttcttttgttgttcatgctataggtgtcaaatctaagaaaccactgccaaactcagggtcatgaagatttaaccctgtggttttttttttccctaagagttcaatacctccaatgcctccattgtggtccattttgtgttcatttttgtgtatggtacaaggtaggggtttaatatcactcttggatgtaaatatccagtattccagcacaattctttgcaaggctatttttttccacaatgaatgttctagccagggatgtccatttggtttctgtgggccactttggaagaagtattgtcttggaccacacataaaatacactaatgcgagtccaggcgcggtggctcacgcctgttatcccagcactttgggaggccgaggcgggcggatcacgagctcaggagatcgagaccatcctggctaacacggtgaagccccgtctctactaaaaatacaaaaaattagccgggcgtggtggcggcgcctgtagtcccagctactcgggaggctgaggcgggagaatggcgggaacccggggggcggagcttgcggtgagcagagatggcgccaccgccctccagcctgggcgacagagccagactccgtctcaaaaaaatcaatcaataaataacaaatacactaatgctaacaatagctgatgagctagagaaaaaaaaatgcaaaaaacccacctcaccatgttttaagaaattatacgaatttgtgttgtgcgtattcaaagccgccctgggccacatgaagccagtgggccgtgggttggaccagcttggtctagacacccaagttgaaaatctattggccaaagaggtgtaagtttatttttggactctcgattctattccattgatccgtatgtctaccattttgccagtgctgaactttcttgactattacaggtttgtagtccattttacattcagaaggtgtaagccctccatttttttttctttcaaaattgttttggctatttggggaacttgcattatcttatgaattttacagccatcttgataatttctgcaaaaaaaaaaaaggcaggtaaaattttaacaggtattgttttgaatctgcagatctatttggatctattggagagtattgccttcttaacacgttaaatcttccattagataactacaagaggcttttccacttatttaagacttccttaactttggtcaacaatgttttgtactttcattgtaagacttggacttcttttgctaagttgatttctaactttttttatgctaccgtaaatataattattttaaatttcattttcagattgttcattgctatgatttaatgcaacagaattatgcatagtgatcttgtatccataaccttgctgaactctcatttattaactctaatagtttctttttggaggattgctttatcttaccatctgcaaatataagtaattttaacgttttctttccaatttggttgcctttcctctattttccttgcctaatagtcctgtctagaacctccagcacaatgatgtatagaagcagtgagagtggacttctttgtgttatttttgctttggggggttaattatctggttttttttacagtttaggatgatataagattgtggttttctataaataacttatcagattgaggaaatcaccttccattataagtttgttgagtgtttttaccatggaattattttttttttctgcaatcatctgctcatttggcttactggctaatctattacctcagcatagtgtattacattgattggtttttgtatgttgaatgaaccttgcattccaggataaattttgctctgtcattgtgcaaaatcatttacatatgctgctgctggattcagttgctgttattctgctgaggatttttgtgtccatatttgtaagagatattggaccgtagtgctcttgtaatgtttttgtctggtttaggtgtcagagtaattacggcctcagaaaatgagttataaattgtttctcctcttctaaactttcaaaagggtagtgaaggactggtcttaattctataaaagattgatagaattatccagtgaatatcccttagtcttgagctattctttgagaaaagtttcgattactaaaccaatttcttacttgtaggtttataaatattttctatttttctgcagtcggttttattagtttatgtctttccaggaatttctttttaatatcacttgttggcatacaagtttttatagtatttccttataatcactttttatataaggtcattattaatgttccctctttgattctgattttagtaatttgaattttctctctgttttcatggtctgtcatggtaaagtttatcagatttgctaatcttttcaaaaaatcaacttttgattttgttgattatctctattattttttctactgttcattttattcacctctggccttatctttattatttccttctatccaccagctttgggtttggttttctcttctttttctagttcctcaaggggtaaagttaagttatcgttttgtaatctttattctttatttttgaaggtgtttacaccttgtactctctgcctgccttgcttctcctacattacagcatgttatgttttcattttcattaatatccaagtattttctaattttccttatgattttttctttgacttattagttgtttaagaatgtgttgtttaatttacatgtagttttaaaacttccaactttccatctgttactgatttctatctttattgtagttggaaaagatactttgtaagctatcagtttttaaaaatttattgaggcttgtttgtgacctaacaaatctgttctggaaaatgttctacatgcacttcaaaagaatgtgtatcctgaagtttttaggtgaagtgtggtctatatgtctgtaaagtgtggttggtttatagtgtcattcaaatctatttttatattgaacttccatttagatatcctatgcattattaaacattgattattacgtcttcaattactactatagaactatttctacctttcattctgacaatgtttgcttcatagattttgatgcacttttgcttgatgcacatatttgtttttttttaattttattattattatactttaagttttagggtacatgcacacaatgtgcaggtttgttacatatgtatacatgtgccatgttggtgtgctgcacccattaactcgtcatttagcattaggtatttctcccaatgctatccctcccccctcccccgaccccacaacagtgcccggagtgtgatgttccccctcctgtgtccatgtgttctcatttttcaattcccatctatgagtggcacatatttgttaatatttttatttcttcttggtgatttgacccttttattaacagataatatccttccttgtcttttgtaacaattttgacttagagtctattttgtctgatattagcatagccacaatagctcttttttagtatatatatgcacacacacacacacacacatacatataaaatctttttctgtacttttacatacaacctagttatcactttggatctaaagcgagtctgttgtagacaaaatatatttggattttttcccattctgcaaatcattatctttagattgaggttttggtctatttacatttaaaaatgttactgatagagaggaagttatttttgatgttttgttatttgtttctttatgtcttaaataattttgtttttgttcttatcagtcttcatttcttttattattgcattctttgtgcttagtttatttttatatcctcctaatttccttttatgtatattattgtattggtcagggttctctagaagtacaaaactaagagtacatatattaggtatatatatgtgtatatatactatatataattatatatgtatctaatataatatatattttatatagagtgtatatatataattatatataatgtcctttcatctcaacatgaagattctcttttagcattggttatagggtaaattttgtggtaatgtacttcttcatgttattaaggtgaaatgtcacaatctctcccatatatatatatatatatttcccatatatatatatatatatatttcccatatatatatatatatatttcccatatatatatatatttcccatatatatatatatatttcccatatatatatatatatttcccatatatatatatatatatatatgagtttatatatgtatatgagtttattaagtattaactcacatgatcacaaggtcccacaataggctatctgcaagctgaagagcaaggagagccagccagcccaagtcccaaaactgaagaacttggagtctgatgttcaggggcaggaagcatccagcacagtctaaagatgtaggctgggaggctaggtcagtctagtcttttctgcctgctttatattctagccatgctggcagctgatgagatggtgaccacccagattaagggtaggtctgactttctcaacccactgactcaaatgttaatctcctttggcagcaccctcacagacacacccaggataaatactttgcacccttcaatccaatcaagttgacagtattaaccatcacaattattaacatatttttgtgtttatcattgagagtatacttaacattctaaatttataacaatctagtttaagttgatactaatataactttaatagcataaaaactatgcttttatagtttcattctctcttctttatgttgttgttgccatgttgtcacaaattacttatttatacattgtgtacccgaaaatacagctgtatatttttaaaagtttattttattttatagcttgtaagataagctttattagcagttgcaaactgataataccataatactgactttttaaattgcctatgtatttagtacaatcagagatctttaattatttatatggcttttagttagtctaatatcttttcatttcaacgtgaagattcccttttagcattggttttaaggtaaattttgtggtaattactttttcatgttattaaggtgagatatcacaatctctctcttatctttgaaggatgattttgtgggtatagaatttttggttgacagttgttgtttcctagcacttttaatgtaacatcccactgttttcttgcttatatggattctgataaataattagctgttaatcttattgaagaatccttgtatgcaatgaatgtatttttcttagtgcttttaatattttctctttttctttggatttcaaaatttcataatatgtcttcatatgagtctctgagtttatcctatatggaggtattgaggattttggatttatagaatcatgtctttcattaaatttaggaagttgttagctatttcttcaaatatagtttctgaccctttctttctatattccaccttccacctccacccacacctgggaaattctataataaatatattgattcacttgatggttttcacgggcccctccattctctgactctttcctttgtctgcctgaatctatggttgaatgcctctagtaaatttctcattttacttattgcacttttcagctccaaaatttctgctttgtttctttttataatttctcttcattgatattctcattttgttatacacaatttttctgatgtcctttaattctttatctatattttctaatattgtctatgttttcctttccttggccttgtgatttttctgttaaaacttggacattggaatattatgatgtggtggtcctggaaataaaatctccccctttatcaggggtttgcatttttcaatattattaaggctgttatcctccatttatttagtgacttctcgaaactttatgcaaagacggtttcttgttgagtgtgatccctacagtctgtggtttcttgtttgtatttacttagtgttttaaaagagattcatttaaattccagaagccaagaacaaatatacagaagaataaaaaaaaaaccctcctccagtctttgcatcttgggtctatgtaggacactttctcaatatttagccaggcttgcactgaagttttagcttaagatgaaaacttatgaccttctcagatttttctctgagcatgcatcttatcctaaacaaggtttctaatatagattttttaaattcccttcacacacaagtctttttggatgtcctaattttttgaagatactctcccagcttttgatcctgggtcttacacagtctattatatgttttgactgtaatcatttggcccagaaatcttggttggttagtttgctttgcagtgtttttgagcaatgcccgtcacttttccagcctatgtttagaggtaggtaaaacaaataatagtgtccttaatcaacctccccgctatcattcaggcaggttagaatagaaatacacaataatctgtacataaggtctttgctctttccagagcaagagatcaggattccaaactgggaacccaaggtttcctcttcgatttgtgctgtgccagagagtggtggcaaaaatacaagtaaaaatgtcataaagctttcctatcattttggagttacatttcttgattcattgtttgcctaactgctgtaaacctttgactctctcccagagttttgacaaacttggttctgacactttctgcttggtttccaatgttttagctggggtacagtagcttgaagccatcattttgctgatgccactgctttggctatgagtgcattgtcttggttcagagaaatcagaatgtatgtctcagagcttggaataaggccatccactccaaaaggacaatgttttaaagagaaatgtagctggaactccctgtgtcaccattacttagttttatgttcaggaaactttgtctagaaaaaaaaaaattagaccacctaggttaagatgtctcaattgtattttccaaaaaactttccctaagaaagctaaaactacatataaatactttttttttttcttcagggaattcttgaatataagggtatcttagataactatttgctcaccttaacaacctgcatgcttatcaaacaataaattacttatcaaggattacttaaagacctttgccttactatgtccatcaagcttaagttgttatcttaaatgttgtcctacctcaataatttattttccctgaaagaccttccttaacacgtgtaaattcagaccccaagttctgtaaatacccagcttattgcttctccttctgaaaaactggcaaaactctgtcaggctggtgtctcctttattgcatgttttttaaaaaatgttaattttgatttatgaacagattggtgatattttgaagaattctatattaagtgagcaacagtgtacattacaatgtctaatagttacagtagaagttattgaaacttcgaaacattaaaaagtgtgtttgagttctgtacctgcctgtagattttaacatctgcttaacttggagtattataataatctaatcctgaggacttcataatttctaatgtaatattacagtttacatatattgatggttttaaaataatttacaaaagttatgtttttttgataataattctgttccacaaaaaaatcgtgcgtatcatttttcccaacctttgaaaaccttgttgctagattatattatgaaaaactagcaaataagtaattgcgaccacttagcaagtgttaccatctgagttgccacaagtatcaagtaaacttcttcgagagtataatatagattgtaaagcagcacgtttgtatccacagatagaattatctgcccaccaaagatagtgaagtgattagtgtcacctcttgcatcgtgaatagttggatggatagagttggttgagattgctgaggtgcttattattaacggcttaactcttaagtattttctctctttaaaatttcccattaaactaccgcacccactggttaatttcagtattagttagctttaagtttcaagttaatagaggaaaaaattttatgcgctttctcctcctatactggaagaggaacatgaaaccgaaacgcaaattctgggtttaatgaatctaagataaatcagtatcttcaaatggcaatataaaaagatggagagctgaagacataataatagactaagcagaaaaccaacaattgtgaaattttcttccttggtgaagaaaatattaacaaagtatacactgacttactccgggaaggttaacgttttgaggcacaggttgataaaaatactgtaatttaagttggtgttggatatgatgaaaacagacactgtttaaaagtctgattatagaacaagaagaactcaagactgcaagttccattattcatgggcaggtggataaatcttccacatttcaagagatagaagatttaatctttgaaataattcaattagctactcccaacttcaggatccaaagaagtcagacactgctttctgaattatgagacttgagttctcattttcttcctaacttttagaaaaatgacagagagacttttccttcaaggaagaatataggtgtatccttctctggctaaacaggacaactccaggtaagagacacatagataattgacatttgggagcaacaaataaagttcaaacaaattgccaaagctggccagaatttgaggaaacactccaaggtgggaaatgaccaaataaacacactttttaaaaaagaaaagctttacaaaaaatctcaggatgaacaaggctttacaaagagtagaacacttcaaaactgtataatctgtaccccttgggaaaacccaaaataagagcagaggaagctatacaaaagctataaaaattgcaattagagatcaagataagaattttagaaactcgacaaatgagtagataaaattagaaacatctgtgaaattttgcaggatataaatcaggaattcttttgaaaattagggggataaaaatcaagaaaatagtagagaacatataagaaaattgagtgagttaggcagaacaatatccctctaggagatgtctcagaaagagacaacagaggaaatactggggaagaaattaagaaggaaataatacaagagaaaacaatctcagaactataagaaataagtctccacattagaagggctcaccaagtgtccaagaaaatgaatgtaaaaggattcactctgaggcatgtagtcatacattttcttcaaaatactgcttataaaacacatatcctgaaatcctccagatactgataataaaaaagtttcatacaaagaataggaaatcagcatgacatgaggctctttatctgccacaccaaatgaaagttagaagacaatggataaaatgccttcagaattcagacagaaatgattttcctctttaaaatgtatttactcaaataatatgactgaatctggatttcagtatgaaggtagagtaacaatgttttcagatattcactgtctcaaacattttccttccatgcaccctttaaataaaaattgaatataggatacaccccaaaaataatgagaaaagaaagaaaggggaaggataggattcaaagaacagaggatctgttgcaagaaagagatcaagagaattcccaagatgaggtcaaaggaaatattgtgaaaagagcctgacaacaggtttaaataaaagcaactggtatattttggagcagtatgaaagtaaccccagaaaggatatctacagaggaaaaaataaaattgacagattttctgacaggtctgtctatatgaacattttattgggaggacttttcggattttttggatagtataaaaatttggcaaaagatccaaagactattaaacaataaaaatgaataatgtttaactataaggaaaccaacaggggaagtgaaaaatatgaaagtataattgtagtaaactatgactcaatagtgaacaatatctattatgatgtcataataattaaaacactgattatggcattaagcaaagattgtgatataactacattttgaaatataaaggtcgggaaagtagacagtaagaaagcttaaatcctcacttgccaaagtagaaaatttaatgaataatgtcaatgtacatctatccaccaacataagcatgttatttggaactatagaagcaagatccaaaagtttctccttccatgattggcgtgatgggagcaggaaccctggtgtttattctatgcacttagcactattgaatgctcaaaatgttttccttgttttcctttgataaaatattaattaattaaaaattgtttggcaccagtacatgtgcttggccattgtgagaagtgctaagaaaaaactttgttctgaattaagaaattgggttaaaagcaagatgcccaaagagtttggctttaaatcttgagttctattccacatatctgtatctgcttgaacatttatttactctctttacttcatatgcaaatatcagataattttactacttaccttgtggacttgttgattcttctcacttctttgttaaggtagcaagataatgatgtaaaatgctgggcacaggaatagcaactgtttaatgaatgaatgactgatgatgatgaagactatagggaaaatggtgatgagacaatcataaatccaacaaaacattcattatttcccaagcatcctcaaaaattcccaaactatacagtaacctactttattctctattcttttataaaactgtatctgatagtatcatctttattgtcatcaaaatggctgataaagtgagaagcattttcataaagacatacaaatttggattatcctaatagtaattaataccaaagttatttggatgtgtattttttcatcatttttcttaattttgacaccattttttgttgacatttttaatccaagtcaatatttttcattcactttgactattcaacgtttttaatatgcatctctatttaaacttgaagaagtctccacacatgtaagatatacacaagtgggaaggtggggaaaagaaagatgcccccagtgggtggattgtttgataaggagtgggttagaagaaggcagataaattatctattactatgattttttaataaaacattaaagaagggtgtaaagattgaaagctaattgttttttgcctagtgagattctgtccttgccattttgactaatgtttcctcaaacattagtttcagaaatcataccatgatttgaggctattaattcccaggaaaagagcatatgacattttgctgctgaatcttgtttttaattactaattacttaaggagatatgagaagcatatagtggcttttaatttcttttccagtttacaatttaaaaaattagtttaaattatttacagagaagatagtgtcacattagtacactaaattgaaatagaattgtattccactgccttggcttcaaatgacttagtgtgcttgaaatgattacctgtatatggatggctaaatagagaaatattaggtgtttagtatgttgtgaacttcttcctggcctatttattgcctaagtggcacttaagaaaattagacaaaattttgcactaagcctgatgcataatcaatctattcaataattcccactatgccttgaccttcataaggtcactccactgttgacaagtcttgtctgtaacttaaaattacagacagctgggtaagcccatcgagtgtcatggacacatctatttgggcacttcttcaatactttgactttgaaaaactttcaattcaccaactggtatcagtggtctaaagagggtcacttcttgattatttgacagctcctggaaatctctgtgttttttttttgcttctctctaagaataattatagatataaaggcttggaattcattttaaacctgtgatagtgtgactacagttcaacataaagattgataatgtagtgtctgttatgactcatatcttagccagtttttgttccccaatgtcagttttcatgttatacacatttccttttagttgagtatgaaaagtagagctagcaacatatatttggagtttttgagtttgtaggcatcattacaattgtaataattttatactcactgagagggccacagttatgttttaggtatattgtaattgcctatgattcctagctttggttggcactgctatttggacattagttgttgatcatcaacctattcacaaattgttattcaacataatggaatattctgaacaagaaattttgcaatgattgtgaaaagttcatacattttggctgtgttgaccatgggcttcagacttgtttccaagaagcatcaaaataattaaaactaaatttcaggcacaataaatagccatgtcaacttccatatctacatgataaagtgagaacggtttgggagtatacagctgggtgcataaacttacaagggagtttctttgaagaaaacaatatttttctcttacaagaattaattcaaatgctgctggtttgtggtgctaaaaaaatgtttctagctacagtgttttaaattcccctgaagaaaacaaaatgttttatgaatattaggattcagttttagactttcttacatttggaaacagggctacttgttggaggggttctcattttacttcacagtgagtgagtggctccagctgacttcttgggtgctttgttgaattggtggaataggtaatagtggtgaatgactaaacatagcagacataaccattagtaactcatagtgacttggaagacacctcaagggaaacagcgttcagccctttcatcttttgtagctaggccttcggtctttcagttgcaagaaacttaaattcaactcaaactaactcaaagaaaagagaaattaattgacccatatagtcaaggagggatttaggagtatttaccgaatagaatttttaaaaaacaaacagcagatgaattaaatatttagaacccacagtttaaccgtgctgggattttctttgaccttctcttgcttctgtttcttgctgtgtgttggctcaatttccttctagtgatcataagctttaaaacaaccacattttagcaacttcagtgggaaagcacatgatatttgtaaatacttatggattaatatcaagcagagagttggatttatccatcctttgagccaaccactattgtctgggaaataggttataatatttgctaactcctattgctcatcgctatgaccagagggctagtgcaaactacaggtggaagaatataaaagacattcttttgtaaaaacaggaaaaaaataacactgcctagcacgtccactgcaccacttcttgtgcaaacacctgtataacatccttacaggtactcctcagcattaactgggtaaaatgtaggatatgatgaaaagtttattagacctggcatctatctcatctctgtttctagccagttttgtggtgatgaaaaagacattttgcagctctgaactttatttcttcatccataaatttgttgctctatcattttcaatctctgtgaataggaattactgactgacaatctcattctgttgttgtagaactcagatcaagctccattgagctaaatgttgtctttcttgcattataatacagaaattaagagtgaactcttatatcagataacccttagtttgaatcctagtatgtggtactcagcaattcactcaaactctctatgtctcagtttcttcattgaaaggatttaattagaagatgtatataaagtgttggcaaaatgcctagcacatataaacactggataaatattagtcattgctcttattagtattattgttttcattattatttttaacttacaacaactggagtttggcttgtcaagagtcgtgcagaattaaagagtctgtctttcatggggacaaatctttctttccctcctgcttcaccatagtttacaattctttagagaagaggcgctttggatacttccccacataatacagacgatatctttcatttctaattgcccaggatcaaagactagttccacattaactaaacggccttaccattttaatgtgttttgaatcatttacaatccagagatatggaaacatagcaaaattttagagtaatggtaaaaagcacctgggaacatggtgtaggatggtgtaggagcaggtaattgagcacagacagttcatttaaatgcctagatcatgtaaaattatttacttggaactggcccaagtaatttgcaataaatgaccttattttttgcatgttgaaaactgctttttttttttgcttgagacaaaatctccctctgtcgcccagggtggggtggagtggcacgatttcggctcactgcaacctccacctcctgagttcaaaggattctcctgcctcagcctcctgagtagctggaattacagacacctgccgccattcccacctttttttttttttgtttttttgtttttttgtttttttttttggtatttttactagagatgagatttcaccatgttggccaggctggtctcaaactcctgacctcaagtgatccacctgccttggcttcccaaagtgctgggactacagacgcgaggcaccacgcccagctaaaaactgcttttgatcattaattttttgacatgtgctattatctggaagaaagtaataacaggtgaaaaaataattgttactttaaatgatgtcttagggacagccaagacataccattagctagggcaaaaatttattcaaactacttcagaattatgtagacagtttttttgtttgtttgtttgtttgttttttaatgggatgggcatttttgatcaaatgtgcaaaatagcttagcgtcattttttatgatttttaattttctgtcttaaacttatatacttttttgaacagtggtattttaaattaatattaatgtggaaaattcagagcattcttgtttcatcatcttgacaaccaggttagactggtaaggtgggaattataatgattatcttcattttactaaaacaattttcccaaggttacacagctagtctatggccaacacagacttgcagacatacgtattataaccaaaagaaagtgttcttattaatggaaaatagggtaaggtatttgttctgtttttctaatgttgctttagattctttagacaaatcatctgtgctaaggttgcttataaaagcatctgaagatcaatggaattaagttgagacaattctgaaatgaaaattcaagtgatgaaattccccagagttcaattatttgagttaaaagtgtttgtaataacagatcttggtacatagttggcacatttctccgttgtgtttttcctctttctatcacctttcagtttctattacaacactcttagggagtttactaataaattaattattggaaagcatatattgcctgaaggtttatgtaccagtagccattagccacaatatgcctagaatagatatgtcatttcccggttgaaatatcgatccaggagaacaaatgaacaaattatcaatttggacatgccaagaaaaaaaaattgaatatgtagccatgtttatttgagacattttactccataaagcatgtttaataaaaagaatgagttcatgcaagaattgcaaacagccagtcagagccatgtgatggtactggaagttgttttacaaatgtatgttccagttcaggagcatcctctcttagtaaaaacttccttttaatagcagcatcttaggcacttgatccacagaaggaagtaattaaatttaatacatgcaacactcattttgaggacaccctcgatttaaagtagcggggggcataattaagtctaatagaaatcatggcttgagaatgaagatacactatcaagcaaacacagaccaagtctacacagaaccaattacctggttaattagggctacaagctgtgtttatttcatgttattcaaccaaagcaaagcttgagggttgatattgtttgtttatttatttagttggaattacatttataattggaattaaatgaatataaaccacaatattagatgagcttaatgctcatatatagccacccaaaaagaaaaacaaagaagtggaatcattaactaagtgtttttaactgaaagagtagatttggaagcatatatatacatagcctaaaccatcagaaaaaaaaaactatattcccctttccactctttatcataagtataacttcaattaaaggaaataactttgatttatagttagaccacaacatagtatctgttgtcctgtctgttatagatcaagtcagcttggtgtaatggaaacaactctggcttaggagttaagagttcgtggtttttatcatttcaattcatttatacttctgtttgtcagacatacgttgaccctacagtgtggtagtcagcagagggaaagatggggaaaataactaaaccaacaagatctaattcttaccattgaggagcttgtagaatactgttagaagtaaacatttgagaataattatggtaagatgtatttaatagtagaatggatgtttgtagaaagagttgtaagacataaaggaggaagaactgaaaaataaaacaggaatcagttactctgtattttcccggaccttaaagggtgataaccaaaggcccagggaagggcaatggaggtagagtcagcagcacatgcaaggacatgaacagaggcccaagacattcctttgagattccagattatatgggggatctgtagtaaaatgggcgtgggactaggaagctctgattgttcagagcagatgaaacctgaggtgaaaaaggaaaagggaggccagatgctgggtacatttatgggatatatgtaaggtttgactttaccttttggaaaacaatctttgaagccaagaagttctttatgttttgcctatattgttacctgaaccctgagaccttatacttccttttatccaaacagtgtctggtatactgtgtgttgaatgaatatgagtgaagaaataattggtaacaattagtattcaattttatatcataatttttaatttatgattttaaggatcatgcccttagtaaattagacacacagtggtcttcctggaatgcgtttatgcctagatacaacaccagaagcacaatgtaaattgacgataataaagaactgacacatgtgtcaagaaacagcaacgtaagcagttgtgcctcagagaaaggcatagagagttttagcaaaaagctgtgcattgggtaaaaatcatggaaaaaaagccaaagaaaagttaactcaggctctccaataatctgattgtgaggtttcactcacatcattcctctaagttttattaattaattatataagttttttgagcacttactgtgctcaaggacattagggcatgaagcaacaatggacactgttctcgtcctaatttggcttgcatttaatgggctaaagtcagcaaggactctttgagagcaagcaacagacaccaccgtgagttctcaccagccaaaacggacttaattagaagcacccagagtagcttacagatggaaagaaagatggaaatccaggccttggaaagaccagagatcaacaaaatagaaaattacgtagtaggaattaatagaatatggaatatatatacaatggaccatggggtgcagtgggggagcaattttgcaaaggagaatggaattatcactaacagaaaagatagggtatattgaataggcaaaatagaacgtttgtacaaaaaaaatctttttctttagataatttctgaggcgttttctggttgtaaaagttctggaagttggcaaaggatcatggtttggtgtttcctacttttttaaatcatatttttctttctttagaatgcaaccctgccttttgtgaatagaatttcataagtgaaggaagctggctttcatctcaaagtgaaactaaaaaaaaaaaaatagtaaaaagttttcctttcaaaagaagaggctgtgattgtctttaaagtagttctataaataagcattctgcagtctgtgacacactttagagaaagagcaaagttcagttctatagctcatttaaaaatatccttcttgagttgagatggtcccacagagatttattttcatggatttataagctctgagaaactgcagtttaaacataggctggctgaaaaatgcttaattactcagtttggtcactgaagcaacaacattagccctctagtcaaagaaaatgacagtgttatcaaaactaacctgcaaagctttattaaaactatctttggcgataatctcttttaagaatgcattgtttttaattagaccttggctttgaaagcaagaagggtcaatgaaaaaaaatttaatcatgtccaagctactgtgctacatctttacaaaattcaattatttctatccagtgtggcacaagaaacatttggcaactgattaaaacaattcttaaagcaaattacagcactgtcagaaaacaagaaatcagaatgtcaaaatacaaggacatttctatgcaaaatgtgttgcaagtgtctttgacagagtatttctgtctgcttgttttattactttcattaatttggtccacatcaagtaaaaagaaaaaaaaatacttccatgtgttagctatttgaaataaaaattctcaaatgaataatattcccaaagataaccaaagtagccatgtggggaaattttatgctttaattttatccaagcttactcagcactgtaaaaatctatgttgaggtttctagctgtagggatcccaaaataactgcttttttttttttttttggcagtaaatccacatctatgcaatttcagctactactaatatgtagatgccattagacgtagatgttatgtattatttcagggcagaataaaacataacaatatgtaatttataatatatttgatgtgcattttaaaaagtgaagttttttaaagtttagaatgaataacaagtttgtttttcttaattatgctttaagttctgggatacgtgtgcagaacatgtaggtttgttatataggtatacacgtgccatggtggtttgctgcacccatcaatccgtcatctacattaggtatttctcctaatgctatccctccccctgacaggccccagtgtgtgatgttcccctccccgtgtccatgtgttctcattgttcaactcccacttatgagtgagaacatgtggtgtttggttttctgttcctgtgttagtttgctgagaatgatggtttccagcttcatctatgtccctgtaaaggacatgaactcatcattttttatgtctgcatagtattccatggtgtatgtgtgccacattttctttatccagtctatcattgatgggcatttgggttggttccaagtctttgctattgtgaatagtgctgcaataaacatatgtgtgcatgtgtctttctagcagaatattttataatcctttgggtgtatacccagtaaagagattgctgggtcaaatggtatttctagttctaggtccttgaagacttgccacactgtcttccacaatggttgagctaatttacactcccaccacatcctctccaggatctgttttttcctgactttttagtagtcgccattctaactggtatttcattgtgattttgatttgcatttctccaatgaccagtgatgatgagctttttttcatatgtttgttggccacataaatgtattcttttgagaagtgtctgtttatatccttggcttgctttttgatgggattgtttgtttttttcttgtaagtttcttgtagatctggatattagccctttgtcagatggatggataggttgcaaaaattttctcccattctgtaggttgcctgttcactctgatgatagtttcttttgctgtgcagatgctctttagtttaattagatcccatttgccagttttggtttttgttgtcactgcctttggtgttttagtcatgaagtctttgcccatgcctatgtcctgaatggtattgcctaggttgtcctctagggtttttatggttttaggtctcatgtttaagtctttaatccatcttgagttaatttttgtgtaaggtgtaaggaagtggtccggtttcagttttctgcatatggctagccagttttcccaacaccatttattaaattgggaatcctttccctattgcttgtttttgtcagatttatcaaagattagatggttgtcaatgtgtggcattatttctgagacctctgttctgttccatttgtctatatatctgttttgctaacagtaccatgctgttttggttactgtagcattgtagcatcctttgaagtcaggtagcgtgatgcctccagcttcgttctttatgcgtaggattgtcttggctatgcgggctcttttttggctgcctgtgaaatttaaagtagttttttctaattctgtgaagaaagtcaatggtagcttgatggggatagcattgaatctataaattactttgagtagtatggacattttcacgatattgatttttcttatgaggatggaatgtttttccatttgtttgtgtcctatttcctcaagcagtggtttgtagttctccttgaagaggtccttcacatcacttgtgagttgtattcctagcattttattctctctgtagcaattgtgaatgggagttcactcatgatttgtccctctgtttgtctattattgtataagaatcacaagtataagaatgcttgtgatttttgcacattgatttttgtctcctgagactttgctgaagttgcttatcagcttcaggagattttgatctgagacaatggggttttctaaatatgcaaatatgtcatctgcaaacagagacaatttgacttcctcttttcctatttggataccctttgtttctttctcttgcctgattgccctggccagaacttccaatactgtgttgaataggagtgatgaaagaaggcatccttgtcttgtgccagttttcaaagggaatgcttccagcttttgcccattcagcataatattggctgtgggtttgtcataaataactcacattattttgagatacattccatcaacacttcatttattgagagtttttagcatgaagaggtgttgaattttatcgaaggccttttctgcatctgttgagataatcagatgatttttgtcatttttttttttacgtgatggattacatttgttgatttgtgtatgagaaccagccttacatcccagagatgaagcagacttgatcatggtggataagctttttgatgtgttgctggattcggttgccagtattttactgaggatttttgcatcgatgttcatcaaggatattcgtctgaaattttactttttgttgtgtctctgccaggttttggtatcagaaagatgctggcttcataaaatgagttagggaggagtccctctttttctgttgtttgaaatagtttcagaacgaatggtaccagctcctcctggtagaatttggctgttgatctgtctggtcctgggctttttttgattggtaggctattgattactgcctcaatttcagaatttgttattggtctattcagggatttgacttcgtcctggtttagtcttgggagggtgtatgtgtgcaggaagttatccatttcttctagattttctagtttatttgcatggaggtgtttatagtattctctgatggtagtttgtatttctgtgggatcggtggtgatatcccctttatcattttttattgtgtctattttattctgctctcttctcttctttgttagtctggctagtggtctattttgttaatgttttcaaaaaacagctcctggattcattgatttttgaagggtttttcatgtctctatctccttcagttctgctctgatcttagttatttcttgtcttctgtcagttttcgaatttgtttgctcttccttctctagttcttttaattgtgatgttagggtgtcaattttagatctttccctctttttcctgtgggcatttaatgctataaatttccctctaaacactgttttagctgtgtcctagagattctggtatattgtgtctttgttcccattggtttcagtgaacttctttatttctgacttaattttgttatttaccctgtagtcattcaggagcaggtagttcggatttgagtgagtttctgaatcctgagttctaatttgattgcactgtctgagaaactgtttgttatgatttccattcttttgcatttgctgaggaagtttttacttccaattatgtagtcaattttagaataagtgcaatgtgtgttgagaagaatgtatataatgctgatttggggtggagagttctgtagatatctattagatctgcttggctgagagctgagttcaagtcctaaatattcttgttaattttctgtctcattgatctgtctaatattaaaagtggggtgttaaagtctcccactattattgtgtgggagtcaaagtttctttgtaggtctctaagaacttgctttatgaatctgggtgctcctgtattgggtgcatatatatttaggacagttagctcttcttgctgcattgatccctttaccattatgtaatgcccttgtctcttttgatctttgttggttaaagtctgttttatcagagactacaattgcaaccccagctctttttcgctttccatttgcttggtaaatattcctccatccctttattttgagcgtatgtgtgtctttgcacatgagatgggtctcctgaatacagcacagagatgtgtcttgactctttatcaagtttacccgtctgtgtcttataataggggcatttagcccctttatatttaaggttagtattgttatgtgtgaatttgaccctgtcattttgatgctagctggttattttgccctttagttgatgcagtttcttcatggtgttgacggtctttacaatttgatatgtttttgcagtggctggtaccaattttcctttccatatttagcacttccttcaggagctcttgtaaggcaggcctggtggtgacaaaatacctcagcatttgcttgtctgtaaaagattttatttcttctttgcttatgaagcttagtttggatggatatgaaattctgggttggaaattcttttctttaagaatattgagtattggcacccactttcttctggcttgtagggtttctccagagagatcaactgttagtctgatggccttccctttatgggtaacccagcctttctctctgactacccttaacattttttccttcatttcaaccttggtgaatctgacgattatgtgtcttggggttgctcttctcgaggagtatctttgtggtgttctctgtatttcctgaatttgaatgttggcttgtcttgccaggttggggaagttctcctggacaatattttgaagagtgttttccaacttggttccattctcctgatcattttcaggtacaccaatcaaatgtaggtttgctctttttacatagtcccatatttcttggaggctttgttcattccttttcatcctttattctctaatattgtcttcacactgtatttaattaagttgattttcaatctctgatatccattcttctgcttgatcgattcagctattgatatttgtctatgcttcacaaagttctcgtgctgtgtttttcagctccatcaggtcatttatgttcttctctaaactggttattctagttagcaattcatctaaccctttttcaaggttcttagctttcttgcattgcattagaacatgctcctttatcttggaggagtttattacccaccttctgaagcctacttctgtcaattcatcaaactcattctccatacagtttttttccgtagctggcgagaagttgtgatcttttggaggagaagaggtgttctggtttttggaattttcagcctttttgcactagttttttctcatcttcatggatttatctacctttggtctttgatgttggtgacctttggatggggtttttgtgtggatgtcctttttgttgatgttgatgctattcctttctgtttgttagttttctttctaacattcaggcccctctgctgcagatctgctggtggtcctcttcttcagacttctgtgctggcagtgagaatttcaagccagtggatcttacctttctgggctccatgggggtgggatctgctgagctagacaacttggctccctggttcagccccctttccaggggagtgaacagttctgtctcgctggcattccaggtgccactggggtatgaaaaaaaggaaaactcctgcagctagctcggtgtctgcccaaatggcagcccagttttgtgcttgaaacccagggtcctgttgatgtaggcacccaagggaatttcttggtctgtgggttgtgaagaccatggggaaagcatagtatctgggccagaatgcacctttcttcacagcacagtccctcatggcttcccttggctaggggagggagttctccaacccttgtgtttcccaggtgaggtggcgccccaccctactttggctcacccgtgggctacacccactgtttaaccagtcccaatgagatgagtacctcagttggaaatgcagaaatcacccaccttctgcattggtctcactgggagctgcagaccggagctgttcctactcggccaccttgccagccaccctgaaaagtgaacttttaagttacataggtctgagccatgtgttctaaaatatattgttgttttgacttcaatttaagtgagatttgtgctttttaatagaaggttgcacatttttcttctcttttaaagcttaacagaaattcaaaggcacacattatagaaaagtgaagctctaggttgataataaaataagataaaccacaaaaaaatctgccttttattaacatagttcttgtcccatgtcaaaattcaagcactagagttttgtattcagccttattgagtcagttagctaactctatgctttgcttctatgtggctgcttgttttagtgaggcagagccttgactatagtagttatccaacacatttgttgaagtatattgagataaagagctataagaacatttgagcctatttgaattgcttggcaaagaactatatattcaatgttcacaaattttatggaattgggtcttcttaaatagagaaagaatttgaatcatggaggagtttctaattatgcctactatattggcaactataatgttgtataagtcagatctcttttaagtaataaaacctcagctgaaactggttcaagagatagacaatagatagatagacagatggacagatagagttttttagctcaggaaataatgtttcataagtagtttggatttgatttaggaattcaaataatgtaatctggatttattctctttcagacacatatgtgcatgggcacacccacacagacttacacacacttctgctttcttggttgttgacttcattctccagtagctcactccctctacgtagttgactccaaatttctaggcttacactctcatatcttagcaagtggtcctggtagaaaagtgatcatccctaattgaatagacataaaaatgtcccagacttgagaatcattccttaaagtcagctgctctctctgtgggcacagagatgaactggactggctctcatcataggtctgtgtttgtgtctggggtataggctccagggacatagatcagtcccgtgtctgggatataagttccagggatataggttggtccctcctgaaagtgaatgaaaatagagacagatggctcaccacatgaaatatcattgtgttaattccagatgaactgttaaaaactattaaaataagtaaatacagtcaatgttcacaactggtatgaaacatagtagtgaaaaaacataagggaaaattatatactgtaacatcacacttggcttatggtcttcattaatatctcttaacttcaacatgaacctcacacaatgatttagtgtcctcaactccaatgatctccattcattagaaaacagaagtcagtgtttgtggcttaaactacggtaggtactgaagacaagtcttggcatacatatgggatggaggtagcttagtgctgtaggtttgaaaccatgtggagctaaacagtctcaaaattccacacccacattgccaactctatctgcatataccttagtatgacaaattcaattattccaacagtaaactaattcagtatgtctcaagctgaactgattctttcctgccaaatcagttatcttctaactttctattaaactcctcatgattcttcattggaagcttccccataatgggttctacaacatattttgttttttaaaaattaatttaaattttgagtatataattaattcacttttaacagtaaaaggtttttctctcttctttatctgttagctccctgtatgatagtgtacacaaacactactataaatttcttataggttatctttttaaagatacatatgtatacacaaaaatgcatacttaggttagtctaaaataagttatgttccaggatctaccttatttttaaaaatacatattttttcaagagacagagactcactgtgttgcccaaatgaaatgcagtggctattcacaggcttgatcccactactgatcagcctgggtgtttggatctgctccacttctgacctaggctaattcacacccctaggcaagctggtggtcccccactccaagaggtcactatattgataccaaacttattgtggataacctaattagtatagcaaactgcagcccagagctctagggctcaaaaaatcctcccgccccagactcccaagtagcagggactctaagcacctgccacagtgcctggctgggctctactttttatccctttacaatatatcttatagcttgtttttatatcaatttaaaataaacaatctcattttaaaatggatgcctaatatgacctgatatccttgcatataatatatgtaccagtccttttttgatgagcataaatttccaactttttgctgttccaagcaatgctgcaataagtaacactgtacatatattacatatatattttattattgagttttaaaatctctttgtatataatggaaattaagctcttgtctataaattctaaagtttttttattcaagtatgtaatagccatgctcacagagaggaagaatcaacattgttaaaatggccatactgcccaaagcaatttatagattcaatgctattcctattaaattactgttgatattcttcatagaactagaaaacactattttaaaattcatgtggaacaacaacaacaaaatatccaaaaaaccaaggcaaccctaaacaaaaaacaaagctggaggcatcacagtacccgacttcaaactacagtaaccaaacagcatggtactggtacaaaaacaaacacatagaccaatggaacagaagagataacacagaaataaggccacacacctacagctatctgatcttcgacaaagctgtcaaaaacaagcaatggaagaaggattctcatttcaataaatggtgctgggataactgcctagccacatgcggaagatcgaaactgaccctttccttataccacatacaaaaattaactcaagatggattaaatacttaaatataaaacccaaaagtataaaaaccctggaatacaaccaaggcaataccattctggacataggaatgggcgaagatttcatgataaaaacaccaaaagcaattgcaacgaaagcaaaaattgacaaataggatctacttaaactaaggaacttctgcacagcaaaggaaactcttgacagagtgaacagataacttatatattgggagaaaatatttgcaaactgtgcatctgactaaagtttaatatccagcatcgataagaaacttaatgaaatttaccagaaaaaaataagcaaccccattgaaaagtgagcaaatgaaatgaagatgcttttcaaaacaagacatgtgtgtggccaaaaatcaaatgcaaaaaagctcaacatcactgatcattagagaaatgcaaatcgaaaccacagtaagataccatttcacaccagtaggaatggctattaataaaaagtcaaaaaagtaacagatgctggtaaggttgcagagaaaaaggaatgcttatacactgttggtgggattgtaaattagttcaaccattgtggaagacagtgtgatgattcctcaaaaacctaaaaacagaaataccattcaacctagcaatccccttactggatacatacccaaaagaatctaactcattctattgtaaagacacatgcacacttatgttcattgcagcactattcacaatagcaaagacatggaatcaacttaaatgcccatcaaggtacactggataaagaaaatgtggtatatatacaccatggaatactatgtagccataaaaaaaggacatcatgtcctttgcagaaatatggatggagctggaggcattacccttagcaaattaatacagaaaaagaaccaaatactgcatgttctcacttataagtgggagctaaatgatgagaacacgtggacacatggagtggaacaacacacactggcacctattggacattggagggtgggagaagggagagcatcaggaaaaataactaatgggcactaggcttaatacttgcatgatgaaataatctgtacaacaaacccccttgacacaagtttacctatataacaaacctaaacatgtacccctgaacttaaaataaaaattaaattaaaaaaataaaaactaaagtgtgtgggttctaaattcagaaaaatcatatttccgagttttggacctacatattgaagctgtgtgaaccaagactaacttccatgtaatgtgcaacttatgaaagtatctataggactctatttcctcatctatgtaatggggttagtaagactcagttgctatgagaaataaatgaggtgatgccttcaagccactgattattttcattgacataatatttgaatttgcatcattgggtagactgaacctcttttataacattggatatatactctgctttataagataacctcaccatgtaagataattgccatgcataatgttcaaaggatcaatatagaccactcacatggcttgaggatgaagacatgtcagcgtttgaaccaatttgttaagcaacaactactagaaaacagatgcctcaaaaaaatcccaattgaatattaagaattttgtcagtcttcaagaaaaaaaaaaggtactgtataccttcacagtcaaaatactggagatttaaggtgactggaatactgccaattcttttgtttgaaattgatttgccctttgaagtgttttggcagaattttggcctcattctcccttttcccaacaaatgcacctatccggctaccataaagaagttacagaaatgttttgctttatataatcaagggaactagctaaacttgaagaatctgcctgaaaacccataatccagggtgactatctctatgttttatcaaattggtttaaaaagtgcaggatctttacttctggtaacttcaggtgatgctctgtgcacatgctcactgccttatcttgagagaacaagaaccagggaataatgtttcctgatttcctgcttgaaatcccttaggtgaacattatctcccatctccctatttacttgtaaacaaagcataacaaaataaaatccagaagattgagagtgttggttctttcagaaacttcccttttggtgaaaatcattagtcagtgaaaaatagctcttcacctaggagacaaataaattagaaaaggccaatatgtttgtgagaatttcagggaaagtataaatggaagaaccagattcacaaggaaaaaatatttcttcaattcagagaggacactagaacaaaacaaaacaacttgatttaatacaatcagagggagaaaaacatttaaaatgtgttgtgtgtaggtatgtaatgccctaacggagacagatatttattacgtatcatttattcaaaattttagtgtgcctgtgtgttgttgtgtatttgttgtacaagtttctgagtaatacttccaccagtttcagttcagcaacctttggaatttgttgagaaaagccaggaactgtactgtagggtcagaatggctgacttctctccatgctttcactcgggtaacgaggcaagctgtcataactatggtttctggtgtacaggggaggttttgactccaatgtcataaatctcagcagtagaaataatcaaataggtaagttctttttgtagggcatgtcagtacatgtcctctgcccaatttctaaagtataatgtatctcttgggttttcaaagtcaggcacaaaatcctcagtttagaatgtacacagtgaccctcaccattactgaatgaattgcttcatgctgtactgtccagaaatatcagagagtaggtctctgtgtttaacaaacacagcactgactctgtttggttcttgcatttgactaggttagcagttgtcaactcggggtgaatttgcccccgcctccccaggggacatctggcaatgtctgatcatgtgtttaattatcacacctgtaacccagtgggtagaggccagggaccctcctccaccacccaaatgtcaatggtgccaaagttgagaaaccttgggttagtttttgggttgagcacaaattcagataaaaacataactcagctccttaaataaaaatttgataaaggaaatgtaacaatgaatatactgaaatttcattttgaagtccctgagattttgtcatataaaaacatgtgggcacagtttcttacccctttaattctaattctcttctgataagtggattttgccaagtgaaagaagactgaaacttatcttctctaggagaaaaaaataacttggttgtttgcattgcagtagctcaattatgaataatctataattttccaacccttgagaaatggcttttagctatttttcttttttttctctaagaaaatgtaagattaaaatggtttttacctatgcaggtataccttgccttaagcaagttctatatatacgaaaacacaaatttataaagaatattaatctgagccaagtgtttgctttagaaaaagaatttgttgctttaaaaaagacagtgtgggaagtttcctgcaaatttttaaatcatggcacatttacagatagtttgacccattttctgctttgggaaacacataaatattaattgaaaaattaaaaatataaaattagcgaatcaattagccatcttaaaaatatctgctaattttctaacagaaatcgcttcatttggctgagtaaatacaatagttgaagtgtaggctttacataagtattgtatctattaaacaggttccaataatgttcttttcttttctctacactgctatcattcttctgtgaagaatggtaccttaatcttatattgaggtaatcattcttatgtgaaaaactgccaaaattaagactttttgtttttcttatcagtctaagttttcaggggtgttaacacaactgaacaggcttacatctaatgcagtattgcatcatggatatgtcaaatacatattgaaaatcacaagaaaaaatagaataacagcattaaatataatccaacccaaatccctagcaactattttcaaaatttctgcaaaatgcacactttattcacttattcattcatcccttctagcaacaattatatatctagtacctgtgggattttagtacccaggagaggcactctagcacctgcatctttggttatggctattcagtttttaaaccacataggcaaggtccttccctaagtttacagtatagaggtaaagaggatgagtgaaactcagtctgctcagtggacagctgatgaagggcagggccatgaaactgtacagaagcagcaaaactagctttgtccagagagtcagggacaacctcttagagaaataacttaggaagaaaatcttttaggagatccaagaaaaagagatgacaaatgagaagataacctccttaagtgcccatggaaatttgaagttcacttcaaaccattcattacattgttatttaataaactcagatatagtggtgggagcatttatttgtaatagaatccaaaagctagactagaatatatagaagattttttttaataatcagtacctaaaagtgtatcagtgatataatctccagagtagattcaccctttttttttttttttttttttttttttttttttttttttttttttactgacaggagtctatctttgaccagggtatagattcaaagagtaaatccataatcgatgagctgcgtacccgtggagaattcatgagtctactctgagtctcagttttgtcattcttaaaataggcataatatctacctttagaattttgtcctgagaattcaaggtaactccataatttctagctcatggcaggtacacatcaagtggtagtttaatttttctcctaactaaaagaaattggtcatcaaatataaaaacatagttcccagacaaaaattactttttaaagataaatgataaatctacatatatataatacatatattatctgtgaaaagcattataaaataatttcttaatttcgtataagagaaataatttaaaaagaacatttgataagatggactggcaaacctgaaagagatttttattattggaatataaaaaaattatataaaattgttaaacatgacaaaaatggaagatgagtaataagcaaagactaaagtaatatgtacacaaaactgtatgatatggaagataatcaattcatatttaaactattacattttatagtaggctgaattatgagccccaaaaatatctctgtcctgattttcagaacctgtcaatatgtcaacttgtgcaataaaagggactttgcagatgtaattaagtaaaagatcttaagatgaggagattatcctaaactatctgggtgaacccaatgtaaccaagcgttaggatttttataagaaggtggtgggaagatgagacttagtaataggaggtgtcactttagaagcaagaggttagtgtgacgcaagaaagggcctgagagccagggaatggaggaagctggaaaaggcaagaacgtgaactctccctctgagcctccagtgcaatgtagcttggccaacacctagattttggacttctgactgccagatcggtagggtaataaatttttattagtttacccactacgtttgtggtaatttgttacagcagcaattaaaaaaaaactaatacaagtctaaacatgcccaggtgttcagaaaatcatgtgaaggaagacggctgacaatggctgacacaataaatgaattgaacagagaatgtcagaaaccaaaatgtattatagatgtatattttctgttgcaaaagtaagcaaaaacatatttatttatttatttatttatttatttttgagacggagtctcgctctgtcgcccaggctggagtgcggtggtgcgatctcggctcactgcaagctctgcctcctgggttcacgccattctcctgtctcagcctcccgagtagctggaactacaggtgcccgccaccgcacctggctaactttttgtatttttttagtagagacggggtttcactgtgttaaccaggatggtctcgatctcctgaccttgtgatccacccgcctcggcctcccaaagtgctgggattacaggcctgagccaccacgcccagccacaaaaactttttatatatttagaattacacagtttcgaaccatattaaatccattttatagcagtatgaaatgagacgaggataatgtgtattgaaataccctgcgacatttgtagaataatatggaagtagcctagagatacctcgttcctcagtgagatgcattgccatttttgtttattaacaaaatcctcctggtcaccatttcagctcacccagaagttaaactccttattctgtatgtttgttcatttgtaattaatgataagtgttttttagtgttagcgtcttcgtagttagcacgaaggagctttacagaagcctcaacttgtttctcgaattttagtaaagttgatttcaccatagagcaactcctctttgtgtatttacatatctctattactgtaattttaatttactgagcaagagtcaacatctatatcattatgtgtgattagacaaagaagatctattaacgttttcctaaacttatactgctttccccccatggttgaccctaccatatgaaaaagagactcgtggttgaaatggtacgttggatgaaaacaatgaatgacaataaagttggagagaggggagaaacagctgctggaaaatctctcttatccaatgtccagaatgctgattgttttggggaggaagtaaatttgtattggcttaggggaaatcagtttgtggacaatactggtttggggaaactttgttacatttctaatttcctgacctgggtcgttacaatcaaacaaaattttattcttttcacttgcactccagatggaagaaaatgtaaacagctgtccaagcggtgatggagccttttcttccacattcttgcatgtcattatgttagagatttactttttcagcaaattgaaacctctaaaccaagcaatcaaatttttccccctctccctctctttgtattccaactgtcatcaattgcttactttcagaaatagttttctaaagatgaagctctgttgaatatgcatggtcattatcatatttactctcatcagtaccatatagcattatgttgtttacaataattagctgctggaggcaatcctgtaaacacagccatgtgacagcccaaatggagagaatcaagtcattgttaagaaagagaataggtatgcgccggttggactcctatgctgtggttattggtggtgattgcaatgtatgggtccagtccaaaaagaaatctcttactcaatacttctctagttgctgggcacatatgaaagaaatgaagacatgagggaattcagatggttaaataaagctaacaagacagatttttctttttaaaattttgtttaagtctgtgggctaaccatattcacttaggaagcaatacatacagtaaaaatgcaaaattaatatatttaacttaaacaaatttagatttatgcatagggtatgcccctatttagggtacacccctattactcatattaagcagacagttgatgcaatcacacagaaaacaatcaatgcaagctatcaaaatctatgaaagtatgtataaagtttatttcagggtttcctgaccattagaaagaattaaaattcactgtttaagcgagcctcaagtagatagtgataaaattatcactattctcagggaagaaattgaagaaaattgagggcaataaagaaatattactaatatagaattagaggagcagatatatatgtgtgtgtgtatatatatatatatatatatatatatacacacacacacacacacaaagctttatgtgttacttaatgggagttttataagcttttcaaggattattttaattttatggaattgctgctttccttgaactgcctcgaaaaatgttactccacaatctattaactaattcaacacacatttattgagtacctcctagattgaaggcactactccatggagaaaacatgaataatcagacacttttgcttttaggagctgacagtctcaatggtactgatacatcaaagtaaaatgtgatgcaatttcatagcagaatcaacagtgtgctaaccaagcatgaagaagtatggaaagtgatgtgagaggaaaaactctttataatttgttcattaaaatatattgcagttttagagttccattgtgtttaccaaattatcaagagaatacagaaaattccaataaatagagaagaagtgggtaaaatgtaggtctttactagcttattttaagatagagtaaatgtatattagtgcatatacttttgtgttttgctttttcttttagtgagagagggcataattttcaaagctgtgttgtggctagatagggaatacacaatttagatagtgaaacaatcaagcccattctaagtgccaaaagtttaatcccttaatgagaatctaaaaaagttttttttttaagtgtctctgagaaatactaatggtaactttaaaaatgtatatatttatatgcttacttttattagcgattcttagtaagctcccccataccaataatctcatattactgagcaatcactccatgtagttagagcaaaagtcttctgctgttgtacggaaaaattgatctttaggctgtgtagtggatgttgttgttgattggcacagatcttttctgggtctgcacttgtccatcaactgctgtgagtattatctcaatggttgtcttttctcggccaagccagagcccctacggctaggaaggtatgctgctctctacctaccctcttccaaagcccagagccaagactgactgtttttcttgccataaaatggaatcaactttctggcactatccatactctggagcttcccactggacaggctgaagttaggttatagctacttagctttttccccctggcttatcctgctttttttactccccttatccagagagcacgtgtccagtacattactggaaaaaagaattctcatctcagactctcttctagggagcctgaactaagttaatatccctacattcccagtacctaacccagtgcctgacatatgtcaaattcagttagtgataattgaatgaatgctgaatgacgtttgcattcatggtattagccatttggcaatactcaggactctcagtttattgcaggatgtatgtcttgatagacctctctacactacaacattcaaaagggaaatcattttagtgaccacttacagattcatgaagtacaacattgaaaatccactgacatttttgttctttgctttttttttctggttcctctctacttaaggaagtcaattttagaggtgatccacttatctgatactagattcagccaagttgcagaagcaacaaccaacacaactaagaacaaataaaatgaaaataaaaataaaaaaatctggagtttaaaaaccaagcgtgttgtagtcaataaagtgttaaaattttttaaaagttttcaaaaatacatgctgtaaataaactgaggatagactagctgcacagcctcaataaaaatattgaagacattatgaaatggtacacttgcatgatgatttataatttacacatgggtattaatttgaaactaccccaaaaaatacagcctacttacatagcttcagaatttaacccttctcccatttttcccccaaaagtgtccaattatctcctgtcagacctgacagtgagttatcttgttaaagagcttgcaattccattatagacaagctccaaatattgatttgtgccttttatttccttggtctttgacatcattgtaggactaaaaatgttcaaatctgttgctgcatgacagaaagaaaatggtcaagagatctcagatacatcaaaaaatagtttactgaatttatacttcacaagacactgtttttgtagtgtaggcctacgtgggtccaaaggagaaccaagtacaaaagtgtgagcagggaacagctttggaacacactcagtaaaggtacctggaaggggcttgtcagggaagcctccatggagtggcctcagagaggcacactgacatcatggcagccaacagagaaggaaatattgtcttaaacagaattcacaatgcctattttgtaggcatgcaaattattaaatatttaatgtgagctcttggggtaaagcaaacaaatatataaacaaaaactctttgtctctttaccctttgaaatctatgtcaccataaatagctagaaaaatgctcattgaacaaataaatgaatgagtgaatgaatgaacgataaattcagaataattactttgtatttatttggcactagatgagggaataaaatatgttccttgaactccagttttcataatcagtttgttcacctgtaattgatgattttcacttgattttaggaatttttggtgtgataataggtggatttgaaaatgtcaggttttatcattaaataaatagtattctaatagagaaagtagaaattgaataattatctaataaattccaacagtgagaactactaagttggataaccaccctgaagtaatttgtatttttctttcagagtaaattcttttaacatatgtttaatttctttaaatgactccactcaacctaagataataagaatagcagtggctttttagagcattcagatttcaaatacattttctggtaataatgtttctaccaaataaaagaggattaactctgtagagtattttaaagttgtgttcttaccgtataatcacatagacatttatagttaatgctacatttcttccatttgcagatttaactaacactttcatgaacattgttccattttttttgttccagtagtttatctttacaataaacaggtaactataagcaaagtgctatcctgagttctgtgaatccttctagaaaattatggaatctgagacaatgtaatgggaacccccagatttatagcctgtgggtcaggacccaatgggaattggttactgacatattaagtgagagcagtcttgtgggactgagaccttaacctgtgggcctgtgctatctaaagacagtgtcagaatggaattgaattattggatattcaggtagtgtcagagagctggagaagacacagcatatttgatgtcaggaggaaaagatccttttatcaactgagtcaaattttgagctacactataaaagaaaaatgtcgaaattgaaaaaattttaaatacaattaaatgtgtacagatagacacaaaaacactgagtggaataacttggagataaatttgaaaaaatatcccttaattaagataaaaaacagtcaaggagagacagagagtaagaaaagatataacaaatttcattggatcaatccgatgaattaaacacaaatttattataatcttttagagacaaaaagcagactaagagtgggggaaggtgtcatcaaataaaaaaaattaccagcacttgaaagacacaaatgtgtgtaggaatacagagaatctaaactgataagtgagaggaatttttaaaaataacatacctaaacataccatcataagatctcaaaacaccaacagaatgtgctaaaacttccagaaaaaagaaatctacaaaatattgagaatcaggctggcatcacatatcacatcattaaaactagtctctaggaaataatgctttcaaagtttgtcaggaaattattttgactataaatcctatttcagtcaaataaccaatgccaaaataaatatttttcagacaagaagactcacgggatatttgcaggtatgtgccagaaaaacttagagtgaaaaccaagagaaaggaagatttgagatacaagaaacaatgacaataacttagaagtgcaatgaaaataagcctcaggatgatgcccaaaaagggaccaatttagaaaaggaaattctaagaatctaagttgaatgtcttcagaaaatgaaatggagtcaattagaagtaataatgaataataaattagaaaatgctaattaatatttgaaaaatattttccttctctggacaagaaaaatataaaataaatgagaaaattacaaaaatacaaggcatccaagtttcaaataaaaagtaaaataaaatgtactatgatcctaagcaactgatgagttcagaaaataaacaatttatctggacgtgactcaagaaatagtttttattaaatgtcttagaagtagtggacactgaaaccacaggaaagaaaagtgaatccaaaatagtttaaatgttgctaatggttttcagtatttcaaatcaattggtagaaaacccacagaagtcttaattatgtttactggaccaaaaacaatgttatcacaactgacaaatgtaaaggaaactagaggctggtggacaaagttgaaggaagagtaggaatactatttttttttgtttttttacatagtggagtgtgtagaaatagtttctaaatgtgatgaaatagtgagatgtttaggtgtagtatttgcagatttaaaggtaaccaacaggataaaaataataaagctcaagatatagggagaaaagttatctgataaatccttgtgttagtagaagccggaagatgctgtctaaagttacttaagcaaatagaactacaaataagtatttgtaaactaaacatagcattttgaatataaaatttgaaataactgaaaccccataaagttaaaagtacttgcatctgggaaggatagctcagcatgaggaggggcagaatgcaatcattggtaaaacacaaagcaaatctttgcttttcttccacattcaaaagtgccaaaatcacctattttaagagtaaaactaaataataaaaaatgcaacaattttatttccatttctttgtttctcataacatttgttaatagttcttgagaacctcttccaaccctttcagcctcctgtcttgtgtcagctgattctgtgcagtctttgaccagattcacacaactgccatctgacagcatttgcctccagtcctgcattgtgccctttgttttctgcctcagggcttctgtgtcctcacagctgtgaaatacccatgactacctgtttaacatacacatatacacacagcagatggcacatgtatacataggaaacaaacctgcatgttatgcacatgtaccctaaaactgaaagtataattttaaaaaataatttaaaaatttttttttaaaaaaaagaagtgtgaaggagttaatgaccttctgggacaaatctaacaaaaagggagtcagaagctgggggaaagatgcttctgagacttacttaagtttcaagtggtgcaatgggacagagcaacaagtcatcatagcaatagaatagacaatgacacatccttgtattgactcttctttcttgtctccgccatccctcacgcttcttgagttcatattctggatttaaccacccacatggaagccactatctctggttctgctttgaagaaaaccaaggctaagacccaaagaccataagcataattggcagtaaggcctgagtgacagcaaaatgcctttactgtaggaatcagtggcgactaatagattatgatattcctttggatgtaaaacattgccagtctactaaggggttactggacttgtgatattaaaaacaaaagtttaaaagagagctaaggagcagaaggctgatatcaaagatcacaatgaaaaatccacggtgtttttgagttgtaaatttccatatgtcacttctaacccagggctacttggctacctgattcgaggtggaccaggaagagcctgtaatgacactacaattgtacatagtaaaaatgcctctgattcttccttagagagaactgtggccatttaccaccatacttgtactctggaaggaggaatatccagaatttggagaatttttgagaattgtcggatataagtctgaactgacgcctgtcaagctatgatagtccactagttaatgtggactttggaatccagattgaaaaaaaaaaaaggctgacccaagtctgtgtgtgcactgtatatatggaccaattatttggttatttccccaattccttaatataaaattggatagatatgcctaattgtcagccagcaaaaccttcaaattggcttcctaccatacagagtaagagttgctatgatagaaaagccaactgaaagattcctaaatatcctttcctttccctacccccaggcaaaaatatgaaatctgaagaaataacacatcccctgaggaaatgtgcaaattagcaccaccagaaaagatttaaaaattgtaatgttagtactccattgtatctctgtttgattgagctgcaacaacaaaaacaataacaacaccaagtgggttgggcagttggtgaactacatataccattaagggtgtagccccaaatgtatctgctatgctacctgtgttctctttgctagaacatgtcaacacagcctttgaaacttagaatgtaactattggtctaatgattgtgttttttgcaactcacatcagaagaagagaacaaaagcagattgtctcttcatgtgaatgacagtagtacattttcagcgtcttgttacagggctgtttacattctcctaccttgttttcatattatagtccagggcaccttgattatctttgaattattcagaatattactctgttgcactatactgaagattatcctaattgacctggtcagcaagaaagacaagtaatttagatgtcctattaagataaacatgccatatggtgggacataaatccacaaaagccctggaactgttatattaaaaatacctttggatttccaaatatctatggcatcctaagacatcccttctaagattaagaaaaacaccttatttcatcttataattcttattattaagggcaagtcctattacttggtgggcttttggatttttgagccaatatctattgtacctataaatactgaccaactgaagagggaagaaaatacctcaagcctatgtaacaattcacttggtgtgaaatgtttctgtgagccaaaagtgggctgatgtctcattgtttttcatctcagaggtggttctaaacaaagtggcaaatagaaatctttctggaaggtggagctgtgagctgtgcattcgttgttctctttttaggcatggtaaagtgaccagagttacaaatacacatcaactcttgaccagtggtgaatggtttgtctggttagtaaagagtctggtaaggacaagaatggaagttaaaaacaaggaacaaatcttgatgatgatttgctcatttctttgtgtctcatgttagtgtccaccagagggcacccactgcaaagaggcggtcaaccacctagctgttgaccagtagagaacaacctgtttggtgaatgtcagttttctttctttggccacaggagtgctagtgcaatgagcccatgaattgagtgtccatggcctcaggaatagtagtgaagcatggattcaacagcatgggctccctcaaagcagagaagatgacgtactgccactgctgattgcctagtccactggcaacagagaccaatcatgactacttaatatgacatcattcctcaaggagtccagccacactcttgatgattataatagacattatccactctaaagggaacagtgatttattcttatcagtactgaaaactactcagggtatagattattttttttctctgccagcaacaccatctgagaacagaatgcctaatctatcattatggtgagatatatgtgtgtgtgtggtgtgtgtgtgtgtgtatatatgtatatatgtcatatatgtatatatgtcatgtatatgtatatatgtcatgtatacgtatatatgtcatgtatacgtatatatgtcatgtgtacgtatatatgtcatgtatacgtatatatgtcatatatgtgtatgtgtgtgtcatatatgtgtatatgtgtcatatatgtgtatatgtgtcatatatgtgtgtatatgtgtcatatatatgtataagtgtcatatatgtgtacatatgtcatatatgtatatatgtcatatgtgtatatgtgtcgtatatgtatatatgtcatatatatgtatatgtgtcgtatatgtatatatgtcatatgtatatgtgtcatatatgtatatatgtcatatatgtatatgtgtcgtatatgtatatgtcatatatgtgtatatatgtcatatgtgtcatatatgtatatatgtcatatgtgtcatatatgtgtgtatacgatatatatgtcatatatgtgtgtatgatatatatgtcatatatatcatatatatacatatatataaaaaactaagatcaagggacccattttgtagcaaaggatgaatgacgatggatgaatgacaatggaattttcaacggttttatcatgtaccctgtcactcagaggcagccagtcaaaaataatgatggaataaactgttcaagattcaactaagttgagagttccaggaacataccctgcagagttaatgctcagtcctctagaatatgaaatatgctctaagcctgcatttaatatatatggttctgtgcatagtgggtggaagacatggatccaggaaatgacaggtaatggtaacattagtctttccatttgcagaattttggcctcccatccccatgagtcctacctcttctctttaactatcttattccaatagacccaaagaaaaagaaaaaagttaatatatgagtagatataattaacccataatgccataagaagcctatttgctgctacacagtggcatctggaagaagtatgtttgcagtgctggcaattcagtggagtatctcctaagatttactgtacagtaataattgtgaaagggcaaatacagcaatatagtttcactagggcaaagtatgcaatattatcatctcttcaaggaaaaatgtctggattactcaaatagataagcaacctggaaaagtaaaattagtagtgaagcatgaagaaagtctagatttggaagtaaagaaatgaaatgatggatatgaattacggcttaagacaagttcagtaagcttgtgaatttttttctctaagtctgttacccttaagtcattgcagggaatttggctgacacaattcagaatctgactttgttactgattggacttaaagaaggtcatgagtagatctgagtggttcaaaggaggaactatattctatgccttgtttttctgcatcatttcaaatattctcatcctgaccaaacattcaagctaatgcttcattcagcctaacataaatattacctgacagtgatccatttctcacaattctcatttcccatccagcagtttctctgatactgagtactcacacaaagctgactcttactcatataggtatgtactctagatgtgtagaagagttaatatcccacaggacaaactttgaccaatatgtggggtggccacacagtctcactggctcaggattgatttcagctataccagttttttcagttactattattaatactttctcctttcactctggttattgtcctgttttacataatggggtatatggtcaccttgttactaaggtatcggagccaatagatagatgcttcttccatgcttaattcaggtggaaagccctgagaggcatttgatacactttaaagatgtctctatactattgaacacgtattcctatatggtgttgaaaaactcaatacatccttttattggcttttccttgctccatttttaactcacactgtgattactgttttctgagatcacgttttgaaatgagtggctaacgtgacaaaaggcaaaaactctttgactgaagctccgctcttgggagaacccagactaagtcagcttggtttcaataagtgataatattgtatcgactagttatggttccatagaaaatcatttcaaaattcagtggcttaagacaagaagaattgatttctctcccatgtatacaagatggatgagggtaaggtcatctaggctgtgcttagttgggcagctctgatgtttactgagatctttggatcaacaggaatagctctgttccaagtacttttcatcctccatggattgcagtttagccaaagtgagtttttctatggtaatagcagaggtaacaagaaggtaagaagaaacacaaacgacaattaaagcctaggcttatagccagcacgttgtgacttctagtcacatgttattggtcaaagcaagtcacatgtttaagccccaaatcaaggggcagagaagtatactccatctatgatcaggcaatggcaagagtgtatgtgcagggaaaggtgaggaattgagactaataaatcaatctaccatatgattataaaagaaatatcagtatatttcctgtgaaagaaaagcctatgacgtatttctggtaatgatgctagtaggccaataggtaaattctatttaatgggaactaatgactctcatgttttctatgtctaaacatcaaagaaacacaacacaacaatttttacacttcataaattacaaacaaacaaaaatggaggagacagaaaagttatttaagagactacactcttgatgcatagtaagattttagagggtatggcttctgacctcttcattatgcctgggaaataagatacagtaataattattacatgtggaacatctctcaatcttcagagttgaaaaaaattagagtagaagaggaatagcattaatgaaatacatttattttcactggggcccaagcaatgtattctataatttagaaagatcacaatgggctttatggtaaaaaatacctctaaaataataagccttgcagagcaattggcactcattaaaattcagtgttggaagcagcaggtggcaggcagtttcatggaacaattttgcagtgtccttccagggttgaagcaaaacaattcatgtcataagataccaggtcttacccagtccccattttaagttgccgtaagtaacagttcctctatttttatatgaatagattcaaggatcttaaattgaatgtattacaatagctttctaaaatatacattttcctaccatgtggtagaaggtgaatatatgcatttcacttactattttccctttgaaaaggaatacgtttcacggcaaaatgttgttacttgtttttccagagggaagtgaaatttgaatatctgtaaaattacacatatgtggtataagtgaaaaaaattgttttgggggcaaaagactaaggaaattgttatcaccctcccttcaatgcactttttcctgagggaaagtaaacgttgatatgtgcagtggatttctcttcatgacactctaatccctaccactccctcaccaaaaaggaaaagaaaaggcaagagaaaaaaaaatgatttccatttcctgggaccatttaatattttctattctttaccaaagcaccgtggaggtttgagacaaataattacattcagaccattttcatgaaaacaagcagttctttgaagaatgtcggacttaactatctaattaattgttaaatcttggcagttatagcctaaaacgttacatatttaagagaaactttttactataccttcaacactagaaataaccataaaattatagcacttattttcgccttctatttgatataccaatggacatagcaggggactcttgacaagaggtttagaatacaaatgctggggttaggtggacttggattcacatccccgtttatctttttaccgttgtgtgatcttggcaaaaacctcaattgctagtcaaaggtgataggaatatctgcctcatagggttgttaccaggactaagtgagattttggatttggtgtctagctcacaggaagcactcagaagattatagaagattattcatattttggtaatattagaagtgtctgtggtgaatagaagaaaagtatgttatagaaaatatttttttaaacaatggttatttagaaaagttgtacataccaatgggcataacaaacaaaccaaagcaataaataacaccgagacaatattactcatgttggtatatgacagatctttaaaataattgtgcatgttcaataaattattatgtgttaatctttgcttttaatttatttggagaaaaaactgtcattacaggtttcttcacaacaaggcaattatttaagagcaatagtcaataatattttcctgtaggaggcagaagtagatcagggttttgtggagcctgaagtttatagcattttgaatgcccacttcaagagttggcagtgaagagcaacccaagtatttcactggaaagtatcaggaaaagtacagacattggatttttccccctctttggtaaggagagaagaggaaatagcagctataggaagaggctccccttggggccttgagggattaaaaaaaaaaaaaaaaaaaaaaaggcagtgcttcctggttcactgaagtggattttactggcaaagaaactttgccacagcattccttcagagaaattctacttgtgagcttctgcctaatgtcggcgtccgccaagtgatgcaattccactggaatgtgtgcaactgaactgttgggatcaatgcctttgcaaacctcagaaggaaaacatatattcagtacaaatgttagctgctacactaaatacaaatgggacaagctaccctataaaaagacaacgccaattttttttcagtcaagctgaatgatgtttataagaaaggcatctaaaacagtgagaaaaagtgttaatattctagtatatacaggaaaacaaaaaccagaaagaaaggagaaatgctgaaaataattcatgtcaaggagatgtaaacatatttaaaaggattcttaagatgttatataatcataaaaacaaaatccactagagatatttatatatgtagtgtgtatatgtgtgtgtgtgtttgtgtgtgtgtgtgtagcctttatcgatgaaacagtttagcagcagaatatatagtacaaagcttcttgaaagataattgctccatttgaaaaatatttctgggaaatatttaagataccgctcacagaacttgacatgtcaagtagacaaaatgtgagaaagagtatagcgatttgaataataaaacaatattagtctagattcttgagtcaagctgcttaggttttattcttcccccactgtcacccagttggatgttcttgggcaatttagttaaactttttatgttccaattttcttgttggttagattttgcaaataatatcaaacccatcaggttgttataaggattgaataaattgctaatgccaatgtaatgctgaagacactacctgacacataatttgagttatagaagttgcctatcaatatgttcatcatcgtcttcatcattgtccagaaaaaatataaatgaataaaactaactcagatctataagaaactaaaatgtctaaacataaattgagattagagaggtgattgtttcactaaaatcaataataataataatgtacacaacaatattttggtagaatgatagacttattgattttattttttcaaagcctttaagagaatctacagtctgtcatcatttaattcattaaaaatcaactttattgaggtatactttacatgaaatgacatatacccatttgtctaggttgataagatttgtccaatacatatacccttgtaatcactgccacaatcaaaaacagaatgtttttattacccgaaacattccctgttgcccatttgcaatttatctctttctccttatccctaaacaaacattctgttttctgtcagtatagaattgcttttttttttttgatatctttctcttagcataatagctgtggaattaatccaagttgtgaatatcagtaatttctggctttttattgctaacttgtattacaattatgcattcaccacaatttgtttatccattaacctgttgatggacatcagtgttgtttccaacttttggctgttataaaaaaaatttgctataaaatttccttgcaaaaatttctgtggacatatgctttcatttcttttgggtgaatacataagagcggggtttctcagtaatattactttaagagtgccagcttgttttacgaagtaattgtagcactttatatttctaccagcaaggtatgagttccaattgtcccacatactcaaaatcttttggaattttcaatgtttttattttattttattttattattattatcattattattttgagatggtgctcactctgttgtccaggctggtgcacagtggcacaaacacggcttaccacagcctccatctcccgggctcaggtgatgctcccaccttaacctcctgactagctaggactacaggcacctgtcaccacgcctggctaattttttgtatttgttgtagagatggggtttcaccatgttgcccaggttggtctcaagctcctgggcttcagctgtctgcccaccgtgtcctcccaaaatgctagcattacagctgtgagccaccagtcccagactgaattttcagtggttttcatttgagcctgtttgattagtgtctagtagctgtgtcttgcggttttgattggcatttttaaaataatgatgttgagcatcattttaatgggcttaaatgtcatttggatatctttgctaaaaatgttcatttttttttcattttctaatgggttgcttatttttttgttattgaggtgtaaaaatttcttaatgatatatttcaaaaatcagtctttttaaatttaatgaagtccaatatttctatttattctttatgttctgtgtttttatgtgtgtgtatgcacatgagttttaagaaatctttgcttaatcctaggactcatacattttctttcagaagtttttttttttttcaacttttattttaagttcggggtacatgtgcaggatacgcaggttttacgtaggtaaacgagtgccatggtggtttactgcacagatcatcacatcacctgggtattaagcccaacattcattagctattcttcctgatactctccctcctcccacccgccacgatgggtaccaagatgtgtgttgttccccctccatgtgtccatgtgttctcatcatgcagctcccacttataagtgagaatatgtggtgtttggttttcttccagaaaatttaatgctgtacctttaagtgtgtgacctatttcacgttagctttttgtgtgtggtacgaggtaaggattaaggttaacttttttacaaatgaatattcatttgttcaagcaccatttcttgaattatgatgcctttatcattgaattacctgataactctgtctaaaatccattcacctaaaatcggcacatatccattagcacaatatccattgaattacctgatacctttgtctaaaatccactgtatatgtgctgatctgtttttgaacacttaattatgttttgttgacctatcctgccaacatcacaccgtctttatcgctctattactagtagtaaattgtaaaaatcacaggatatgtctgccaactttgtttatcattcgattttactttcttggttaattttattgctacataaattttagcctcatttgatgattgctacaagaaaatctcctgatattttcactgagattattttaaagctaaaaacctattgggagataattgacttcttaaaaatattgagtgtttttgacccatgaatgtggcatatttctttacttatttaggtcttaattaattttccttagtaattctgtgtagcctgtagtgtacagaccttgttttagatccttgatacccacacctcctcccccagtgtttaaaaattaataaaatgagaagatatcagcaaagggatctgagaaggagcaggtagtaaacgagaagaaaatttaagaaattaagcaaaagcaatgcttaaaggaggagtacttggtaaactgtattacttgtgagtgatacatcaagtaaaattaggactaagttgaccattgcattattctatgcgtaatttaatattgactatgaccagaaacacttatgtggaacagtggggacaaaagactaatcaaagcagattcaagataaaatgagaaaagatgaatggagacagtaagtacagagaattccttcaaggtgttttactataaacagaagcaaggaaatgcagtagtagacagaggaagacggtatgttaaaggggtgctgatttttaaaatgggccaactagcagcaaatctctttgttgtgatgctacagaaggtagggagagttgatgattccacagagagagacaagtgggtagaatggtcccttgagtagaagactatctaaagcacaggtggatggcttggtctaaggagggagcacggttcacctcaagtaacaagatgaagggagagtctgtggtcacaggggccaagtatgtgactagatgtagtgacaggagcttattgaagttttcttctggttcttattcctttttgggtaaaatagaaagcaaagcaatcagctgtccttgaatatgagtcagactgttggagatttgagtaaagggatattctttaagcttgaatgaatttctttccacaaaaaaaaaataaagcctactacataatgattatttttcttaaaactctgcagaaaaagtcatcttggcatttttacaaataaaatatatttttattcctacagagcaagaaatacttctattttttttaaaaaaaaaaaaaagaggcaataaaaacagatattctttctataaaattattagtctagtttgccttcttatgaattgggagaaacaatagggtagcccattttgagtttaccttgtgttaggaagcatcatctcctttctaaagcctcttataatgttggttagaccctgtgaagaaatccataggacatagtcataaaatgtagtcatagaaaccttcttgctcatcagatgaaagtaaactgaggccaagaaatatcttttgacttatttccatttgatttggggatttcattttctcagtatccacttactttaagatgctaagagtataatttctttgtatgccaacatgaaaataagtccaaactatcattcttttctcatgttatagttatgtttgtatgcactagagtctcagtgtgcatgtatgtgtaattcctattccttagttttcatccttcaagcagttagtcccttcaaaacccgatgacaagacccaaacatattaaaaagtttagttggagggcccagggtgaaacacaaaaacaattcttcttcttacagagctcttaggcaaacacatagacacttgttctctgcctctggaattacaaatatgttactcggaaagcagcaatactcttttggacttgtttgacttcactttctttacctgtctttaagaagcctcatacacacatttaaaaaatacaacttataaaggttttagtgatagtgcatacaatcatttgattttatttcccttttctcttcaccttcactaataggagttactggcatgcttcaaaaagcttacatttgaatactgtctaaatcagtgcagacccttgaccagcttaatctttgcttgcaaatgacaatgcagtgaaaccagaggaagaaaaaaattacttcctttcctgttggaaacctaataagtagttagtctgacccagttttcaataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctgtaagtacaaaattgtgctgtgtctgctgcaatgagaatattgctgggcaagctgcagcttttcttcctttcaatgtctttgtattagcataacaggtaaaagctggggttgggggagaagtcactgctttattgatgctgtgtttctatgatgctgatgtttaaaatgcatttattccttgtgtgggagaaatgtattgaatctgtattccgggaggttaggatcaaaccagggaaagaaagactacaggtatatttctcagtgtttcactagtctttgctgcagtaaaactaatgggcaagacgggatgacagtgctaattctgggactttcagatggctacacgccctttctgtaacggcagatgggaaaatgtgatcgctaaatgttttttgtcttttttttttttttaatcaaagggatgaggggtggggtttgcagttctcaccggatgatttaaaagaatggttataaagtttcctaggggagaatttggtaaggggagcaaagcaagactggaggtcatatgggctcaccaaattttgtctggcattttgctttatacccagcttctagataacagcctctggagtttcctttaccatttacaccagttaagttgtcagtattaaggttcttataatactttatgaaaactttcagaagttgatgacttgggaacaaaacttttaagagctctgagattagccacgtataacccattatgttaatgggatactgtaacattggggtttggggggaaaattggaattcatagtttttgcttctccaaatgaaaactacttatgtttaaataatcagcatcctgactatgtcctctgagaaacattcacagaatgactaaatagaagttatactgagaaaaaatagagtgaacagtagaatcacacagaatcaatttggaaaatgaggtattcataattttatctacagtggcaatgttttctgaagatgtctgtaaaagaagaagcatatgctgaatattgaattgcttgttttgagcaattttcatttatctgatgggtttatcatctttttatttttgttgttgaaggtttcaccaatttatgtgcattgtattttataaggaaagaaatgtttaagcagactctttttccctcctccttcacacacatgtgtaaacatacgcatgttcacaaaacaaacataaacatacaaaaatacttacacaatttgtgtaaaaaaaaagaaatacagaagcatttcatctttgatgtttcagtggggtttctttttctttttttaagcaataatcatggctgtgcagtccaaagatttcaaatatataaatgtggaaacttttatataaagctttatgtgaggttatataaatgcataacttatcacatcttagcaaaaaagtcaatcatttataaatgacttcattgcattacttcctttgaatatttgtagtgaaggaccagaatttttttttagaatttttatgtagctttccttaatgaaaacaaattcacttgtttacttagaaaaggatcacatattttctctgagtttagaaccccctctaaaaaaaatcaattatgttgtgaaaaggatgtgtggtatattaaattgattgcatacttctgggttttttttttagtaagtaaaaatgctcagtagtataatagtaaatttgtaccttttaaattcttttatgtgaggagaaggaatacaaaatatttgcttatttattcactgtttattttaataacatattaattggaatgcagaagtataagttctacctattaaaaatgactcaaactatacataaaagttcaaaagggaaaacccatcacctgtaaataacaatcatgaaatttggcgactatcattggagacatactggtgcctaaattcagataagatgagagataaatacttttgtaagaatggtttcttactatacaccttttaaaaaataaataataaatatttagataatatagtcaataatagatactcttctgtaagaatgagatcttatcctacacttaaaaaaaaacagaaatattggccgcgcgcggtggttcacacctataatcccagcactttgggaggccgaggcgggcggatcacgaggtcaagagattgagaccatcctggccaacatggtgaaaccccatttctactaaaaatacaaaaattagctgggcgttttggcgtgtgcctgtagtcacagctactcaggaagctgaggcaggagaatcacttgaccccgggaggcggagcttgcagtgagcagagatcgcgccattgccctccagcctgggtgacagagtgaaactccatctcaaacaaacaaacaaacaaacagaaaacagaaaacagaaacattgagtttaatttttgattttagattttaattaaactgaaaaaagagaagttgaaacaacattgaagaaattgttaaatttcatgtatagatttctctccaatggagatattatgtccagaataatacccttacagttaagaccaaaaattttgaaaatagaaatagtttgaagatttttttggatgcacgtttaaatagtaaacaaacttttataacccttgttatgatagttaaatgcatttgcaatgtgacttgtcatcaactccacccataccacctcaatttaaactacatcagttttacattactgagtacatacattctggctgaattcccatggtctcagtttaaacttatttcaaatttgtaaggaattatcctttatcaacaggcttttactacccaattcaccatttctgtgttctttattttcaattattttttgggttgttagatttcagtaagtagtacctctccaccaaagaaatagtcataggtgctatattttctatgagtttgcatcttgaacatgtatttcttttgccttagacatgcaagatacgttatctttcttggatcaagcttaattttttcttttggaaatgtgtaaatgtttaaacatttttggagacccttcctgtactgaaagttgttttgcaacatttttaggtctgtctgcaatttccgtcattgaatgtgacttgctttttttctgataaatgcctacatgattcttttgttgtgtgtgtgtgtgtgagtgtgtgtatgggtgtttgcttttacagaatattcctggatttgttccattttcattaactttttttgaggtttgccccattaatttaagattcttttattttaggatttgttgtactatttcttttttgtcccttaactgggcgtggccaaattgtggttatcttgcttctttcttttcttcaggatcaccaattttgtacatgttgtatctcatttgtctactttccacatctttcatatccaaatttcttttcaattttaattgacaaattggttatcttctttatttgagaaccacttgttctcttgtttgccacttgaatgaatagtatagcttgcaataaacctattaaggcacaaccttctgtattgtgatcttgtaaatacatgtttccttctcttaacactctagcaatttcctcagctggcaggtttttgggcaatctgtatcctcctgaaagtaagagaaaaagaaagtactgatcggttttctctgatgtcccccaaaggtccatgatttttagtatttggctacagtggaaatgggcttcaagtcgtgttttggggttttgtccactaacattttcactgaagacggagggtttttgcttcgttttttatctgcaccacgaccactgccaccttttatatttctctttattgtttctgtgggacaatagaggacatttaaaaatctctttatttaaggagttttaaatagcaatctttcagtttggaggaattctttgaatgaaaattttattagaatgttgttattctcagtattcatattgaaaagagctgttctagttaagactgagttcatctgcatgatgtgttgtagtattaaacatttattacggtaaaggcgtaacacaggacatagtagaggaaaaacagagccattgggcatgccttctgataatgtcccctattagtttatattgatgaagtctgtggcctacttaactattttgcaatgagtcctaaggtaatttacagaaacgttacatcatagtaacatgaatcaaaatctgtagactcaaatcctttttgaaagtatactgagtagaaaacttatatgtattaggtttacaattaaatgaataaatgaatgaataaataactgaatttccctatatttcaaatccttaaaagaggcaataaaagaacatgatgtgtcgtatgaagtattataaaaaacgaatgatcttactaaaaagcaaatagcaatttctcagtgtcaataaaatgatagtgagagcaagattcaggaggcaagctcttgagctgaagtgccgcccattgtagatttccttccctatatctagcacagaatagctctgtggtcttaggcaagtttcttagcctctttgtacttcagtttccccattcatagtggagataatattagtattgactttacagtattttcaagagaattcagcaggtaaatatgtaaaaaatcttggaagaaagcctggcaattaagaagcactctatgtgttagttgtttagttattgttatattattattgctattataacatttatatatgagccttaggatcaattgggtaaaaataatataaaacaatgaaaagactaaaattataattatcatctaatcaattgtattgggtatttaatagagaattaaatttggagtgtaaatcataagtggatattaaaatagagctcaggaaaaatggtgagaagatatagagatgctggtctctggatccaactagattaaaaatagaaatggtatttctgtatacaccaagcaattggacatgatcaagaaaaagggtatatttgcgggggggggagggatagcattgggagatatacctaatgctagatgacgagttagtgggtgcagtgcaccagcatgtcacatgtatacatatgtaactaacctgcacattgtgcacatgtaccctaaaacttaaagtataataatactaataataaaataaaaataaaaaaaagagaaagggtatatttgattttttgattataaaagcaatgaacagaaaagcacgagaacaaataagccagaatttctttcttcaaagaaaaacatcacaaatacttgtacatttctttcctgttgttttatgttgttgttgttctttttttatgataatgccttaatcaagtaatgtatgcacctggaaacaacaacaataaaatttgaaattatagagaaaacaataaaataaaaaataaagacctttccatgatttcctgtcttatttcacagagatattttctatagtttattttattgtaatgttttccttctggccaccattatacatttgaataatatatttgacttctattgcagaatctataaactcaacatcatgtctgctgactccatttttttaaagatgggcagtttttcctattttcacactttcacaagacaattttaggtgttacataagtctttgaattcttttggcagtaatgcacacacacacacacacacacacacacacacacatatatatatatatatatatatatatatagtgggaaattttaagtattcaggtaaggattaaatttaataatgaccaattcccacccccagaattaccaaatgctaaattttattggagatttaacatcttcagtattcataaaatgaaaatactaatacaatatataataagggcctacgttgtaactctacctagtccattcctcattctacattaccatgaattgtatatttacatataattgttatatatgtatgcctatataaaatattattttaaaatattatggaaatagtatattgaaagcaaacttatttaacttgtgtaactcattccatattagactatttagactcattcttataaataaacacatttcgccgggctcagtggctcacgcctgtaatcccagcactttgggaggccgaggcgggcggatcacgaggtcaggagatcgagaccatcctggctaacacggtgaaaccccgtctctaccaaaaatacaaaaaattagcagggtgtggtggcgggcgcctgtagtcccagctactggggaggctgaggcgggagaatggcgggaacccggggggcggagcttgcagtgagccgagattgagccattacactccagcctgggtgacagagccagactctgtctcaaaaaattaattaattaatttaaataaataaatacagttctaggatatatttcaccttatgtgttttatattcttattattcattcccttattgagggatatttaatttattgaaaatattcactattgcagtgttctattatcacatacattgaaaacttatacacattaagtgagattttcattaagaatatcaagtccgtgctgcatgtcaacaatttcatgtttgttatttctggtctcagaattcctatgtttcaacaaatgtacttaattcatccgcacctactatgatgttgatgaagttggacttatttcttacttcttacttcatattcaaccaaagtgttttttagtaaacagtcttttattggtttgaggaaatattctttattcattttttcaacttttattagttaaaaatggtatactccctttatcgtattttagtaaataactattttaacataaaatgtacttttatattttcaaataaagactaaagatagtgtatatatcttcttcataaacaggacaatgacttgtttaaatttactctgagatatttctcccagtgctcatatttgcactatttatttttaaactgcccccaatatttttgtcaaggtttttttagacttatgacgtgatttcctgagttctttatttaccatattcttgctatttatgtgcatctcctagattctcttcttgtgctctgaagaccattttaaggtcattcaaaaattgttttaaactcccttaaaatttatttgttgaaaatcgcttatgttagtcacattctaaaataatactgtagttcatcagagcactctatgtggaagatacttttctctcaacaatttttgcatattctgttccatgatcttctggaatataattttgctcatgaggggactgtttatgatgtaattatcacacttttgaataaatattcgtcttttcactcggacagattttaagaatttctctttgtcattgatttcttcaagttcactgcaatgtatgtagttgtggagttgtttcaaatttatctcatttaggcctctgcaagctcctaaatctttcttccattctgaaaaattctcagctattatatatttcaatcttgcgtcttttaaatccctttattttctccttcaggaatgctcattcattatttctaggcttctgtctttgatttctttgcatttctttcattttctagtgttgcagtcagtgtaatttctaccaatctgtattttatacttttattttttaaaaaacagttttaatttctataatttatattgctcttttaaaaattatcctgctattctgcttgttcttaatagtttctctcccattcttaagctctcaaaaaaatttcagtaagtttattttagattgtgattgttttactattttaatttttagagtcaaatttctttattacttatgtctgctggatttccctcatggtggttcattcttcctggtgctcataatttttttatgacaaattcaccttcaacagatgttgttttctatgggagaccaaccttgtttgagttgtgtatgcttttgcatagcatcgcattgctattgattctacagtggctctacaaatatctctggttctggactattttatatgtgaattttttggcttcaaattatattaccatatagacagaatgaatttgggccctacaaccaagcatagtacacattctgggttctgattgcctttttcggattcttttttctaccagatcaccaagtttccataaggtcagctatgtaatgcaaaggacccctttttgggaggttattccaactttacaatctccttgccagtctgagtttctctccatttggtgcctctgagggcttacctctttaacatttaacctcggctatgtgtacttcttaaagagttttatacttacatagcatttacatgtgtttgtagtggaaaagaaatccctcttcacgttgcatggtgccgtgtacttccctatacttccatgttggctggacttgttcccatccgctttccatcatttagaaagtcatcaaactctcacttgctggtattttatttttatcaggtactcttatggtttcatggagttattttgtaataggcaatggaacatttgctaatttttttctggaaacattgtcaagtctcaggtatataatctaataagaaatggttaatgtcaattgtatatgtctttccattggctccacaaacattactgtaacaaattaaagtgcttgttttagtccaatgacagaatatgttagggagctctagaatttagttagaaaagcaagccagtggatgttattagtttatatattctttgggagtggcagctctattaattccttaagtttaatggtatgcaaattcttaaaatctagaggcaattattcaaaaactttgttagcacagcaattcctagtgacacagtacaagctgaatgctaaacggaccatatttttaagatgatttctgctgaataaaagtgagaatattggatgggtccttttaaaatccttttttaaaagtcttcttttaaggcgggaaggagagatcaaataagatatttggtgaagtttctagtaatttatcattcatgcatgtaagaggccaacatgaatgagctctcaaaagaatgtagacattttattttcaatgccttttttgcatattgtttcaaggtttatttggtttcccatatttgtatgtctaatgtggttgtgtaaggagctctatatggagaccgctgagctatctttctaaatagcaggagtgcaatatacttgctggaatagagcttttagtgaaagaacatgattttcctctctggcatctatcagggtctcccaatcactaaagcacagtaaatgaaagagaaactcagaaatcaggtgtgccgctaattttctatcaacagagttaagaataaattaagaacagtcctgccgggcgcggtggctcccgcctgtaatcccagcactttgggaggccgaggtgggcggatcaccaggtcaggagatcgagaccatcctggctaacacggtgaaaccccgtctctactaaaaatacaaaaatgagccgggcgtggtggcggcgcctgtagtcccagctactcgggaggctgaggcaggagaatggcgggaacccggggggcggagcttgcagtgagcagagatggcgccaccgccctccagcctgggcgacagggcgagactccgtctcaaaaaataaataaatacataaataagaaatagacatgcattaaaataataggtaggctatataatacacagaaaacatttatacaaaattaatgtccaggccgggagctgtggctcacgcctgtaatcccagcacttttggaggccgaggcgggcggatcacgagatcaggagatcgagaccatcctggctaacacggtgaaaccccgtctctaccaaaaatacaagaaattagccgggcgtggtggcggcgcctgtggtcccagctactcgggaggctgaggcaggagaatggcgggaacccgggaggcggagcttgcagtgagccaagatggcgccaccgcactccagcctgggcgacagagccagactccgtctcaaaaaataaaaataaaaaaaaaagaaagtccttaaagttgtgctgagatgaaaaagtttctgttattctagacttgatagaacacacttgtttaaagtggaacatgaaggtgttttctaggcatttaatgtcgttagtcaattcctaaacatgctcagttgtgaatctgtgttgctgacaggtagaattttgacagccctatatataaatttaccacaaaagtatatgctgaaaatggttctattagaattagccggtgcttataaaatataattttttcagagttgccgactttccttttttgttgtccctttgtgcagactgtgcctatgcggtttgtagaaaagagaaggaagttttctatctgctttctttagggcacttaggtggcaaaagtattatttttactgacttcactcttattctgtcttttgtcatgcagatgtacggagtgattttgcaataaacagaaacaactttctcatagaaaaagagagactggagtttaaaggaaaataatctattcgttatgcgtagttcaacataggaagccaaacagcagtttttaagaaattacacacacaagacacaatgcctgagccaattgcttttaccattagggggctccttttacttatgaggcaaaagtcatttttccaaagaaacatggaacaaaaattcattttctgccagtgaagtttcaagattcacatatatctttaggtatccaaaaataatgttagtctttgagtattagcccccggatgttattttcttttatgattttttttctacatgaaacggtcttcaattcgtacaaaaattctagttaattctgataaataatttaacgtactaaattaccaatattaataatatttttattcaacaatatatattagtaataattccacaaatattggctgaatacttactatgtaatagatgctatttcaggcactagtgatgcaactatgaacaagacagagaagagttctgctcctgtaaaattcacatctgatgcgtattcttgaattcaatgaagtatacaactctaccaggtggaaaggggggctaacattgttaattttcggtctcacctgacaaatgagcattagaagccattaaattatttaattccaagatgattattttagtaaagtaaacttgcatagtgagatgcaccaaaaagactaaataaaaagaaacatatatttactaagaataataattattcctctgtttttatagagagtgagatattctgggtttttcagaggattaacaaaaataggatctcacattatacacatgtttatggaatttcctaatcacagacccaactctttccctgaaaggtattcattttcgtcaagtgaatagtaccagtggatttactaagaaggtaaaatttgttcaaaatttgcaaactacactaaattattgaataaccttggtaaattagtacgtatataacaagtgaaggaaaattaataaccaacagaatatcatttaatacatttttccagttataaaatcatatatgtttattattacaaaatttggagaagacaaaatatgcatagattgttattctattactctgcatgtggcatcctttcagtcatcttgtatatgtgtgtacgtgtgtgcgtgtgtgtgcatttaaaatacaaaattgaaattaatgcatatgttctgctttatagcttgtttttattaattaacatcttataaacattctcaagtatcattaaatattctcctaatgctgaaggatttttcaccagatgggtgttccctttttactcaaaccaataacctattgttagatatttatcttttacacaatttattgaacaatgctatggtacatatccttgtacctgaatcttttaatatgtgtctgattatttcttaaaaacaaattcctagtagtacaatttgcatgtcaaattgtgggtttttaaaaatgtgagtgtgtatattactaaattgtcctttaggaagacaactccctctgtacttgcaggcaggtgagtgctctttgtgaccatccttgttaatactaaatattattaattgtaaatactctccgattggattacaaaacaaatacacagataacagtatttcagtattgctctatattacattttttggaaaatgcatgcctgaatgaatatttcatgagtgtttgaaccattcatatctgctcattttgctgaagtcagcctctgtcctttgtttattcttttgatattttacattttttcttatgctcaggaagttcatcagatatcggtgagataacttgtaattttcacttttcttcaagtttataagacatttaacttattacattttaagtgtgaaaccttgaaaaatgttttataaattatttgaacctcagttttcaaatgtacacagtgcagccggtaatacctgacctggctttcacaaactcagaatggtcagataaaaactgaaatagttaatgtttctaaatgtatttttatagctacaagtgatataaagttattgttctagtcttattaaagataaatcagtgtttgtccctaattgcacatctggtcataagcaagtctacaacttaaagtttcctaaatataggtccagtgttatcaactttttacctccggcacctagcattgtctggcctgtggtgtgtgatcattaagtgcctgcttaatgaatgtagattctaagtatactagagaaacataaattaaatacatctgtgctcattccaagtatgctattacagtgtcatctaaatctaatggtgaacaaaatagcacatattaagatgatattaatgttaaacttcaatttatgcctctgcccttggtaaccatgataatccactccatgatgaagcagtcaggaaatgtaagtagttatttatttcatcactacaaattgtatttgagacctgtgttttggaggtaatctatattgtgggctcttcaggaatttggtatgttaggaaaattcaggactgcataaggggaacaggaataggtttgagggtaaaaggaaattgtaatcatccctgaattaaaaaataatttatatgttacagacaggtaaagtatacacaaggtgtgtgatattttcttcttcaaaaaccctccccaaatgtgagatatataacttgcttttccagatagtcagaacaagaaagaacttcttatttttgttttagcttgcatttacgttgccataacacattatgttaatatttgatgttatttgactttggcagaacataatgaaataaggtgtttgactttgccaaagagagtttttggaacaaacctgtgtttgatttagatctgaggccaggtgttcaagacgagcctaggcaacaaagtgagacccctgtctgtaatacacacacacacacacacacacgcacaatctctctctctctcaaactttggcatatttagtaataaatattaaagccatgaaacaaacatattttacttatagcttagaataatcacctttataaatttcttaagtgatttgtagtacactgtggacttgactgttacttttatatcaggttataagtaatgttggctagacgtctatccaatgaactttccctttcacttcacatattctctgggctcatggttagccagaacaatttagaagccaaaaacataaccaaaattatcacatgtatttttactgcatggtgggattattttgttttattgacatatatcattttggtcaataataataataacaataaaacagcgttgagttactcaaatattagttggggctcttcagagaaatagaacgaatagtgccacattatctatctatctatctctctaaatatatgaattttccctttctccattttctgttttattaagggtctcaatggattacatgatacctacattggaaatggtaatctactttactgagtcccctgactcaaatgctagttttatctggaaacaccctcacagacacgtccaaaatattatttaatatgggcaaaccatagcctagtcaagttgacacataaatgtaatgatcacaatgatactagtaagagaaattcagttgaccttgctgataaataggtatttttcacacaaaagccagaaaatgatcataaaatatgtcatatggtttaaaattataattgttgagtacccatttcaaaatatgattgttcatttgaagaataaattttaagttggttcaattctatagataattatgacatgactgaatatttattcatggcaaatccaagagcattcatttgcaattgccattcatgtagatgtcaaagatgccactttttattgcacatattgtgagagggtaaaacaaataacctttcctccttaaaattagattgctcattaaatgtgtcattaatcatattttagactccaaaagatcaaagtaaaatggctctgaattttaaattttccagggtgacaaaagctgaacagtttattaatgtttgaccatgctccaggtgtggtggctaatttctgaagatgatgttcctctcctttcaattgcctttcagctctcatggtaggtgctaatgtgtataattagcatgatttcagagttgtgacctgaacgacagaccaatatctataagggttgtggtccagccaggttagaataataccaaattgatatgcaattaattgagcttgcaaagaggttactgaaaggagttaggtctaaattgcagtttcaaaataaatcacccgaaattatttaagagtataactgggactccccaaaagttacctccatctgaaaggtttagatttggaatctccagttgtgatgataaatataattataattaaggctctgggtgttaatgtcagtgttatgcagaaaattaccctagacatagatagctcccagcatctacatcccgttttcaattttatttctaataaaaaaatttaatccatttgaggtgacaaaattccttagagaataaatgttttttaaccttgggtagtagaataaaatatagagacaatgacatatatcaaactcatggtattagaagttgtgtatcccttatccaaaatgcttgagaccaaaaatgttttagagtttgaaattttctgaattttggaatattcgcatatatataatgagatatcttggggattgggacccaagtgtaaaaacaaaattcatttgtattttatataagctttatacatataacctgaatgcatttctatatggtatttttaataattttgagcaggaaacaaagttttgactacattttgactgtgatgtgtcacatgaggtcaggtgtggaatttttcagtttggagtcctgttggtgctcaaaaaattgtagatcttgaagcgtttcagattttggatattgagctcttgagtgctcaaactgtaatatcattgagctgtttagaattaagtttgtattaattagaatagtttctacatgtttggtgtaaaaagtgcttgttatatttaaggctctaaggagtctttgccagatttgatttgtatttgcacttttaattttgtaaataaataactgattttagacttacccgtttaagttgaaaagtactgtatataaaaattaactaactttttagaaaaagttttgaaatatttaaaagaagttaagatttactattttgtaagggtaaatacaagaattaaattcttaggtttttcttgttaaggacctactgttgatttgtcagactgtttagacactttaagagaacataataattcaattttagaattaccatttaaaatatttaaagcaattgtagtaaagtaagtcaaaagtcctgattgtttatgtgtgtttagtctgttcaacatgaaataattgaattttaattgtggcaaaagagaagaaagtttttcttgttttaataagattataaaaagaataacagacatataaatgaggctaaaaattttaagggggaaacagcgtttgcatttgaaattataataaatttgatattatgatccccgatgagcactggggctctaaggggattcaagggacttgcccgagactacagagcaggaattcacatacagattttcatatacgaatgcagtggctgtggtttccacattcattctcaaaaactcaatgtacctttttggagatgcatgcaaaattgtagaggaaaagaaagtaatatttagaatatagtttctaatcttttattgttaatcttcttgtttacaatttaccaaggcaaaaaagaaacacttttaaaatgtcaaaataatataaatattatctaccattgtttttctattcccagtttaatagacaagtttctctgtgtggcaataatttttaactctaaacagagccagtagctcctctattactttggactttttaaaagatatagttattttgagtttgcattcacacatattctaacttagaacacacaaaaatttacattatttattttctcttaacatatttgcaaagatttagttatatctgcaaaaatgatatattttttattcttctatttttacccaagttgttgatgatcttctgagatccatctgaacagaaaaggaagagacacatacttctatttatatacacactcatattttgtgtgtgtatacaaccttattagcttcttgacaaagaaactaaagagatttaatttttaaatgcttcttcccatactctatccttttattataatttttaagtctttaattatttttacatatctcttctatatacaggtctttatagctgggtccctactgctgactcagttttgaactacccatcgatcttatcttaaaattgttgtctagttagtggagcatttatttatcagcttttccatttgcttgaatattttacatggccaaatatatatctgaccaatgtccttctttaggaacagtgctttatgtttttcacatctgatatttacatcaggtgcattcaaaaggcagtgaaccaagtcctataaaaacagatagaagaatcacttttaagtattaatgtcagaagaagagaattgctttttgatttaggaaatgtaaatagtcaatcttattaaaagattgactttaaaacatatccaactctgctaaacaatggaagaatctaatctttttttgattgaagaaaccacataaaacaggtataccatcatggggaaggtaggtactttctgtattactgtcaaaagacaaaaattgcctcttgacttaggattccataaacttttatggaggtgtgcatggctggaagacatcaataccatgcattgttccttggatggtgggctaggcacatattctaacctttgaacatttctaaaatagtatctttcaaagctggcaaatttggggaaaaagaaattccttatacagacgaagcttgaaggaaggtgatgtatgttgtaatgggtttgctaagattttcacttaatattcagcagccctgagaagttttcttatcttctactctaagtcagtactttgaaaaaaaaaatatgaggagcaggtttgacaatgttgtcaggattgtgattgagatgaagctagaacgatgtgcagttgaagtcctcccaggtcctgattcaaatctacatctgatttcatgacctctgctgcattcctctgtcatgagaagagcagggactcttagtccgatgacagaatcaaccttaccctttggttaattagaaggggcagtagtaaagaactcgaattttagagccaggcacacctggatttgaatacttgtcagatgaaccacttactacatgattggccagagacatacactttgatttcactggcctcatttttcctatgtgtaaaattgagaaataatagttgtcccacctcatatgattgtatggaggattaagtgagattattgaatctaaaagtcttagcacaatgtctgacatacagcaactagtagtgaatttcagccagtgtagcattattgaaattattatgaataagggactattgtagatgttatgcggaaagcagtagtcccctggggccatatagtgaaccccagtgctatttagctcatttctattgtctacgcattatatacagttcaaattagtaacaatcacaacaagaacaaccatcaattgatatagtttcaggcactttctttagtactttaggctaacgtatttaattctcataaaaacctcaaaggatatgtggtatcattccccatcttatagaaaagtaaaatgagattcagagatgtaaagtaaatcggttaaatagaaaaaacagttgttagattgtagagtcagaattcaaaaccaggcaggcttttgccaaaattaacgcattttaccaccacattcttaattcccaaacagagcaccaagcaccctaggatgcaacagtgaactcagagaaggatcataggatgtaattaaatattctggtgaaacagtgatgctcaacatctgtcaattactgagtgtgaggtagtttcatttcaacacatatcttattatatttctttcaatatcatatatttattaaagctgggtttccagcggatgttgtggtaaaaaggaaatactgtgtgaaatcagtgtagaacaggaaatgaggctgggcaatcttattccaagttttgaaaagttgtgccgtgcccagtggtagtatgcttgttgtaagtagaagtgggtacttaagaataaaataagaatgctatttttcctctaatatatacatattatatttttaaagcatcctgtaagtcacttgaatataacttctttgagccaaaatacttaaaaatggaactattatgtagttattttgccctaggggtgccataaaaatgattgatccactaaggagatcatgatacgaataagctggggaacctctgaactatattattcagtttatcagggaaatatgtaaaacttaaggatcagttcatcaaacctcattaaccacctgttacttctcaagtacttagagattcctttctaaaagagctcacagcatagtaagaaagatagacactgtgttagtcagggtcctccagagagacagaatcagttaagtatgtgtatagctattatgacagaagtttattagaaaaattgagactctcgattatgcagactgaaaagtcccaggacaggccttttgcaagatggagcccttgggatgctggtagcctggctcagtctaagttcaaatgcccccaaaccagggaagcccatggtttaactcagtccaaagccaaaaacctgagaacctggagtgcttctgtgtaactccaaaagctggagtttcaatgtcggaggcaggagactagtgtagcccagctctggaggcagagaccaattcaccttttctgtttttgttccatccaggcccccagctgataggattgtgcccacccactttgaggacagatcttccccttagttcactcagactcacatgctaatttcttctggaaatgtccttgcagacacgcccaaaaataatgcttcactagttccctaggtattatttaatccgatcagattgatccctaaaattaaccatcacagacacaacgtgcatactgaaatatagtgtgtgaaccaaatttccaaggggccagactcccaggcaggtcacataaatattcaaaaggccatagcattaagaagtgagaggaagttgtattggggagaaaagcaaacataagaaattttccagaagagatgaatgaaagaggtccaaatgcatgctatttatagaataatgagtatggtaataatggagcccccactaattacactatcacttattaaatacttgttacgttccaggcaatgcattaggcactgggttgtagagatgaaagtcagagtgactttcctcaggctctgacgtctcttgaggagtctgacaagaaaaaagtacattcaggcaaatgataagagatgagactggaaagcatggctgtggtagaagtaatatattgcctgtaacttctaaagaggccagggacttttagaataattaacacaaggtctaattactttggattaactagtaaccaaatgcattcacaaatattgatgttattcaaatttgcttcatcttactaaaaaagatgctgtatttgtgtattcttctgccaaataaatgagaggcatatgtatatttttccagaatcatgacttattcagtttatggactaattattggttgagaagataagtaaataacaaattatcatatgaaaaatgtgagactgggagtaattaatgcaataaaatagattgctcaatatgcgaacaacttcattgtaaattctaggaaaagggcctgatttcagaagaaagataaagtcatcaaaagtcttaaggattaaattaaaagataattttaaacatttactgctgtagtatttaaatttaatgattctggcaatgagactattgaatatatgctgtgttatatgtttaaggggatggactcaggtagttaggatgtgattattactgtcctacgccctctagttaaatcctgatagaattctagttttaactgaagacctctatttaatcataggctgcatcaagttgcagacacaattcatgaatactcatatataatggcatcatgctactaaaacacattagttaaatactctcactcactcaaatggtagaggagaatcatctttctaagatatctctccatgactacagtatgggcacagagcaaggacaatcctgtctcctacatggtcaccattcctttatttattcattcagtagagattttcgtgcacagaggcagctactgtgatagcacaagtattacagaattcaaaagagaaagagatgatttccagctcggcaatcagggaagtctttaagaagtaggtggcattcaactaaagaatacactcttcggttctgtgtggcttgatgagtatacaccattataatcgcagactttggcagaacgggagggttgaaataagataaaagaaaggagaagagcagtggcaaaggcagaatgactggtaacattaattgaagaattctttatttgtattcaccagtgtgggcctctttcctatttagccatcacttgaatgcacgttgtcattagcttgctttactcatcctatgaatcaagccttggagatgttgagaacccagtttctgtgtgtggcagaaaagtaaagagatgaatagaagtaatgacatagaatagcatcctcttgctttttccactattaattctattctgccagcagatatttagcagcttttttgtgttaagtcctatgtggatacaaatttaagaaatgacacattttctttctcaaggggatcacaggtcaataggaacacagggatctgtcaaagatcatgataaatgtaataaataagagaacataaatgtggacatagtaaaatggtagaccagaaaaggcaaaagataattattgatgatggtcaaggaagaatacttcgcaaaagtggtatttttagtctcaagacattgagcaaagacattttttttgctctggtcatcccataaaatgactctcaataatgaatagaacaagaaacaaaaaactaaatttcattttcaatgaaacataggagaaaaaagtcacactaaagtgctttcaaaggaggacaactggaagaagcaagtgaattactgtgcagactcccctagaaggctcagaagctgggcatcttaggaggcagtggtagaaatgcttaaacctaaaatagagggctcatctgaaagtctgtcacttagaccttctttttctctcaacctacgggaggttggaaaatatttgtaggtaaattgagctgcaggagcagcacaatttcagttttaagaccaaaaaaatagcagaaagctgggagtttatatgatccttctgtgtataaggtgaaagacacataaatataaataaatgtaacatatgcacataggctcttaaatacccatgtttagaaattccccagtaaaaaccagagttagccttgataacctaagaagaaagcccacaagtcaacaagccacaatgatgagcacagataaatgaatgtattgctagggttatcacatttgaggagtcctcagtaaaagaaggtaagaccccaactaagtaattactggcattatgaagaaagattaagaacagttccaaaacatcaccattttcttcatagagattttaaagcctttttcaatcataaaagggaagcttaaacaataaacaaaagggccgggtacggtggctcatgcctgtaatcccagcactttgggaggccaaggcaagcggatcacaaggtcaggaatttgagaccagcctggccaatatggtgaaatcccgtgtctactaaaaatccaaaaaaaaattagccgggcatgaaggtgcatgcctgtaatcccaactactcaggaggctgaggcaggagaattgcttgaacccgggaggcagaggttacagtgagctgagatagtgccactgcactcccacatgggcaacagggtgatactctgtctcaaaataaataaataaataaacaaacaaaagaacaccaacagagaataagaaagaatttgaggacgtttcagttatgatagccagactcacaacaaacaaaaaaggcaacaaaacaacacttattacaagaattgtaagataaaattgaataaattatccagaaaggagactggaaataaaaataagttgatgatagtagcagtaacgtcagaatgctaaagaatttttaatcctaaataaaatgatccatatcttggaaccatagtgatacagaggacaccttcagcaaatatgagagtaaaataaaaatcctttttgtattccaaaattatgtaaaatttattccctgtaatcagaaatctgaagacatgctccaaaaatcaggaatacacaaaggaagctaaagacaaggagtgtaaaacaggagagtcaacaaggagaaggattaagggaagtccattaataatagcagtttagcaggcctggagaaaaacaaatgtgtattgtagtagtgtaggaaagggcttcaaagaaataactctagcaaaatcgaaggaatgagtggattatctgacaggaactatcatgaggaaaattgtatcaagacgattttatagagtacttgaatagcaaaaacaaacaaacaaacaaaacctcttctgtagatgccaaaacaataaaagcaatgaaacttacaaataaattattaactcttaaataaaaaagcaaaagttgtttacaatgaaaatgtgatcatactatttgaatcttcagtggacaacatttgtataggcttaagcatgaaagtactgaatatggaatatggatggaaagaaaacctgatatagaattatattggaaaactgagtggagaatagagatacaagagggtcgtattgttacctgttaaaattggatgccaatggagaatgccaagtcatcaaatcttttttttttttttttttttttttgagacagggtcttgctctgtcgcccaggctggagtgcagtggcataatctcagctcactgcaacctctgcttcccaggttcaagcgattctcataactcagtctcccgagtagctgggattacaggcgcctgccaccacgcatggctaatttttgtatttttagtagagacaaggtttcgccatgttggctgggctggtcttgaactcctgacctcaagtgatccacctccctcagtctcgcaaatttccctctgtggcttcacaggcatgagccacagcacccagccggggaatgccaagtcatgaatcaaagtatcaccgtgtcatagacattatttagagatatggaggtaaatgccagggagaataactggaaaatagagtggatgcttacagggaatggcctagggaagagatttatattgcctttgttgttctcaggtttatttggcttcttaaacacacgtgtgcattacttttatataaatataaataattgcttaaaattagaaaaatgaatctctgacaaagatttggagtaccatttggtgtttaccaggtggaccaaggacagaagaacatggtagccagagaggtaagaaaggttaaaaacaaaaatcagaaacagtaagtcctgttcagggaactgcaggtggtttgatatggctgaataattaggaggcagaaaagcaatgtgttatagtggttatgggttcaggctctggaccctatctttctagttttgtttgatcggtatgtgacttactgtgtgaccttactaagttctttaacatctctaagcttttgtatcaatttctatatgtgaaaattgggaactttaatttgtactgcaggaaatgaacctacaacctgttagtatgcatttaagttcacctgcagatactactggagagttccaagcttctctccttcaagttcctgcattgctccctgcatctttgaggttccccagaacttgctaaccaatgcatagggcaaaccagaaatgctgactggaagtagcaacaagtgatttaatgttcccagaggtattcctgaactgatgaagtaaaagagtaggttgataaatataccaggttctccatccctttatacagcaattctaaagtgtatattatatagaacctcagtgggtctacagagaaactgagcttcagttctttgcagtgtgattcacaccattctgcacattttactgaattttctcccttccctgtctcactttctccacactctgatttgtgcttctggtaatcacttcccaaataagcccttgcctcaaggcccgctgttgaagaaaggcaatctaaacaaatacctatgccatgttttcaagaggattaaattatatgctccgtacttagtaaggctaaatatgtaactctgctgcggtggttgttaaatgccagcatacgaggaaagttcatttatgcctgtattatcagttaagttattatcctaaaggtgaagagaagcctttcacaaaatgagttcaatccacaggactcggtgactcactgaacacgtgtggtgaggagcggggctagggaaagatagtgctctgaatgactcacagctttctaacctgtatatgacctgtacggaatagtaatgctcacaagcaagaagcataatagaacaattacagttttatttctaaacaaagcctaaagtcctggtttcataaatgaagaaaataatgctgtctaggtaaacaatttggccaagattcacaattcactgatccaaagtcctaagtcccccaataatgtcctttttctgtaagttttttcaactatcattcatctttattattcttgtctcttgaggtcatgattggtgcacaggtggtcaatataggtaacataattgctgaaagaattaataaagatttatttcctaaatcgatccaattcatgttgttttcttctattcaagtactggtcacttggtctttcatatagtcatgtctctctaattcataatttaatggaaattattttggcaactccagcagacatctgagagataagcatagcttttgtattgttagtgttttctgccagactgaagaccttggtgttaataagatggctgctttccaatacctcttaaaaaaaaaaaaaacaaacaaaacaaaacaaaaaaacaccattttcctctctcctttttcttttatttacaaatgtaatctctgatccatgaattcataaggtgagaacggtgagtggctagctttttatgggaccatacataaagggctaaattcagtgatccatctcccatctttctaactacttagggaaggaatttgaaaagaagtcaatgtggcagatttgaaggagaggctgttggaaagtgtgccacaggcttttttacattctgtcttcgagacaatttgagtctgcattttttaagtgaaactattagtaacgtagtgatttcaggttttttttttttaagttggtagatgtaggtcataataggactataattttatttatttattgatggtctgattttaagcccttagaatattaatgtctaggaacatttgagaaagaataacagaaaaatcgtgtgtgtgtgtgtgtgtgtgtgtgtgtgtggagaatgtctctttggcccagataaactcttcgagctttgacatcttaaaaactctatgattaccatatttttatacatagtcagatacatataggttcatagtcctgagaactggttaaactgagttgtcttattgccagggtctgaggaaatttgaaagagagcatcatagaagacagtgtgttgaacactgttaggctagtaacaaaagaatgagagccacaagactaaaagagaattccacttgtgcgtaaacagaacttcagttactagataagcatggctttttcctcatttttctaccctttcctttattcactttccatcaccccccttagttccctccaaaatatgaaattgtcattgactttattaagatataactcacatataacaaaatgcacacattttatgggtccagttaaatgaatttgaaaaacgtgtatgcccatataaatccctgttcctccctatcaaaatacagaatacttatatcacccaagaaagtactttcacacttttttgaagtcaatcctaccacatttcttgcctacaatgactgatctgattttgatcaccacaaattagtgtttttctgattctagaacgttatataaatggaagcatgtagtacggtgctttatgttggacatttagttcagcacattgtcagtttcatccatgtatttacacaaatcactacctttttcctttttattgctgagtagtattccatatgccacaatttgtttatccattcacctattgatggatgtttggtttttttcaagtttgggcttattatgaatcaaattcctattaacatttaagagcaattctttgggtagatacatgttttcatttgtcttacattctactttagagaggaattgatgggttatatgtgatgtttatcttagtaaatgtttttgaaagtggttgtgtcattttacattcctgccagcaatatacgaaaggtttagctgttctacctcgtcatcagtgtttggcatggtcagtctttttagttttagtcattattctgggtatgaagtgctatatctcattgtagctttaatttgcatttccctaatgacttatctttttatgtacctattgactctacatattttactttgtaaagtgtttatgaaaatattttgcctatttgcttctttttaatattattgttttatatattttagacacaaccttctatcagatatatgtattttgaatattttctctcagcctctgaagagcaggtagtcttaatttttataaagtcaaatttatctatatttttatggttggtcatttttgagtcctaagaaatctttgcttatcccaaggtcacaaatattttctcctatgtttccttccagaattgtatagttttagtttttatgtttactctgtgatctatttaaaattgatttttgtggatagtgtagagtttcatacagatatcttgtttttctgatgtcattttttggaaagatcatattcctggctaaattactttctttattacaaacttggaaaagcctttttaaagcctcttagcttttatctaatggtagagtacataaagtcttctaaagtttgtttggagattagcattattcctttgaatattttctacatttctgattttatttaaaatatgaacatagtagataggacacatactacataatgatcattgtttaataatatagaaagtaaattaatatagccaagtcactgagttgggaagaaagtgtgtgcagttactggcctctttattttctatgtaactccctttcctttttctgtgtcttcatatgtatgtaaatatttcttgagaggtatgtagtactgagctactctattggaacacagagttaaacaaattgacaggatcattattgataggagcttcagggaaaacattgttagaactaatcattacaagttttttgaaattgaatctcttatttataaaaaagcacagaaacatcagtattccatagctcctttataaggtctttgtgttatgaagctcatgttgcaagatggatattgagtagtttgccatattaattttgatttgtatttatttgtaaatatgatttcatcacattaaaacaagagctacaataacagaactttaagtaagagttaaaaatattcaccaccaatctatttctcctaccttactgatttcacttgcctgtattcttttgctaatctttgtatatagtcagaatgtttatataaggataaccatactacagaaatggtttgcctttctgattttttttgaaacatataagattacaaatatttttcatgttgctacacagccttcatatttatccattttaatgactacgaagtagtctagtaagtgatggatagtaagaccatcatttacctattttattactattgttgagtttaggtaggccacacatttttgcttagagctgactccaaacatgagaaaacacatgtgtattgccttttccttctttgtataatttatatttagaatatcagcataattaagtgcttgagaataaagaagctagatttttgtattgaaatcccacctttgccattttccagctatttcactttgggcaggtgttctgatctctctagacctcagttttcttatttgtaaaatagggataataacagtgcctgcctcatatatttttcatgaagattaaatgaattatttttttgcaaatcaattacagcagtaaaatgaatgtaaaaactatataaatgtcttcttaaagttctggttaatggaactagtatattaatttaatttatattgtccctgaatgtatgtgcatatccagatataccacagtatgaccccaaccttgcaggaaatatacatttacaagaaaaaagaaagagagagagaggaaaagaggaagagagaaataaataaaggaaaaaaaggaaagaaagaagggagggcgagagagagggaaggagggaaggaggaaggaaggaaggaagggaggaatgaaggaggaaagaaggggttctcaaccagcggtgatttaaaaacacagtttattgaagtataattcccatgacataaaagtaaccgttgtaaagtggacaattcggttgcatttaatacaggcacgatgttgcacaaccaccactatcctcttggaaaacatttgcatcaatccaaagaaagaagctcttaccaattagtaaatttctccccattttctccctttcactttccaggccgcaacaactaccaatctgtcctctgcctatgtagatttatcagttctggatattttgtataaatggattcatgcaatatatgacctttgtgtccagcttctttcacttagtataatattttcaaggtttatctacgtttcggcgtgtgtcagaacctcattgctctttatggctgaataatattccattttatgtacatatcacaatttgtttgttagttgagcatttgggctgtttccaccatttggctattttgaatgtgctactataagcatgtgtgtacaggtacttgtttgagtgccagttttcagttatttagggtatatacctgggactgaaatgatagggttacaaggtggttctatgtggagttttttggaaaccacaaaacgtttccagtaccacactgttttgattatcatacattcatatttagctttaaaactgggaagtataagtccttcaagtttgttctttttccaagttattttggctattcaggcccttgcaattacatagaaatttgaaaatcagcttttccataaccgttttctaaaaaagccattggaattttaacagggattgccttgaatctgcaatcacatgagtagttaacactgacatcttaaccacattaagcctcctaatccatgaacataagatatctttctatttattagatcttctttaattaatgtcagcaatattttctagttctcagtgtacaagtctttcactttctctgttacatttattcatgggtattttatccttcagaatgctattatacgttgatgtttttttcttaatgtgcttttcagataattgctggcatataggaacataactaatttttgtccttattttttatttgttttttaatttagtttataaaactaatttttatattttgatcttctacctacaactttgctgaatttgtcctttagtagctttttggaagactgagatttttatatgtaagattatgcaatctgcaaatggacatggttttgttatttattttcttcccaatttagataccttttattcagttttcttgcctacttgctctggttagaacttccagtacagtgttgaacagcaatggtgaaggagactattcaagtcttgttcccgatcagagtgggacagatgtcagtcttttaccattgagtatgatgttagttgcaggtttccctccaatgtcctttattttgagaaagtttctttgtagtcctagttttctgaatgtttttatcatgaaagtgttttggactgtgttaaatgattttctgtgcattaattgatatgatcatatgaggttttctctccccttcattctattaagatggggtattcctctgattgtttccttatgttgaaccacccctacattcctgggacaaatcccgattggccataatgtataattcttttaatattctgttggactagaggtgattttggctcccagtttatattagcaatgtcaagatatttttgattgtcataactggaggagggtgctactggcatctggtgcatgaagacaaggatgctcctggatgttctacaacagagaggaaagcgttcctttgtctcacaacaaaggattagccaggccaacgcgccaacaccacccagattgagaaaccctgaattataccaaccctgctactattcttggtataccccacccttatctctctagcctgtcattctgtcttttcccctccatctcctccaaacacataactttgtgtttcagtactccaaccacactgaacctcacttaatttcttctcttagtcaagttacctttggcctattatcttccacacctgtactttttctaatccgaacatcctgtcccataagaatgatataatcgagtttggggactcagggttgggggagattgggagggacctgagagataaaagaacacatattgggtatagtgtacactggtctagtgataggtgctctaaaatctcagacatccctgctaaagaacttatacatgtaacaaaaaaccacctgtatcctaaacattattgaaattttttttaagagaaagaacatcccttccgcttcttcactccccaacatcatcacctggttttacttattatgattcaattttcggccacttcctccatgaagattttctgactttccttagaccaaatgagttacttgtgctgcatttttcccaaacaccagcattgcccatgccatagcacttatcagagtttattaaaatcacgtgttaatttctacaaggtctgggagggtcgtattattgctcctatttgctcactattgtatcttcaagacccagatcagtgccagtcacaaagtagtcattttgttattcttgtttttaagttatagaatgaatacaagaataaatgaataaatcagcctaaatttttctgtatctggaacattcaggaaatgtgatagttaagaaatatgttaatgttttatgtgtgtacacctcagatatgcctgagaaacagaaataaccaatggaaatatttttattttagttatctaaatctttacttatctgtcttggccctaattgactaaaactatatctgattttttaaaaattctcaaatgtttgattcagtatctgtgcagactgagacacagacccaaagctttacagtgtgaatttttaaaactaaatcttgaataaattatcagatacataagcaaaatttggaagggaaatttgggacaaaagaaagcagttcattttagccttttacatcaatgggcttggaacatgacttccaaggaattgctggtgttccctggcagtgcccaatttctgaagaaagaagcaaaatgtaatctgcacacagtcaaatgccagaggcaatgtgagtattatgcaggttcaaaccaggtcagaataaaaatgactactaaccagccattcagcttgtaaaatgatagaagaactagttcttgcttattgcccttaacaaatattaaaaaataagtcagagtgtcagctactagatgcaccaagttttagtgctgctttatgggctagaagtgtttcaagtaagagttggctgtgatgtgaatttctgtaaattaaagcttagctttccacttaatctaatcaaagtaccggtaatatattctaatgatgatatgacaaccacagacatattgagatagtatcattttaggagaaaagatttgagacaaaagccaactccatgttatgatggtgaactagataatgttctgcttttcgggcactgtagttttcagtttgcttttagtttcagtttggctttagtttggatttatatttcacaggatttttcaaattgtattctctctttccaccgttaactataccccaaaacacgctagaatcgtaggaattctcctaggcctaagaatcttctcaagcaatattatttaccccagagtatttttgtctttcccatatgattgtctaaatatttaaatcaatgactgattttgagaaagttgctggttttattagcttattttccttgaaggctttctaagcctccattcctcactggaaaatggaaaggtataccgaaagttgaatcagtatgtgattttcaaaaacatgtatatacatgtattcaaatgtgtcctaattataaatgtttattaaaataaatatgattctactggttaagataaaccagattctctaatttccctcctttgtcttgccatgtagaatggtgagagtccatttggctcagagaatgttcagtttgaccttttccagtcagtttatctaaagcagcagcaatgatttccaatctcattataccccaggtcactgtcttattatcacatttattcccctcttcatacttatcacaatctttgttaattgtaactctgcctattttcctactgtctgtcaccaccatctttagaataagagctccatcatggcagtgagcatgtttgccttgttcaattttgtatcactgacatgaagagctcttagcacactcatcaatcaatatttgttaaatgagcttttcttggctgcagacaccacattttattgactggaaacaatgtcttgagccaagcctgaagagaagagaaagtcataatctttacattcagagttacttcctgtgtcccttcaacgtgattcttccaacatcaccaaggaacttcctacatgattgaagaaaagatagaaagaaagtcatctggagagttaacacatttcccattggtgctgaatattatctcctaatattctgaagatgtcatcaccaggtcaatggaatctcaatatcctaagttatatatagacatctgcatacatatgtacattatatacaaatacaatattatttaatacaaattatataaaagtatacaaattatataaaagtaaatttagtttttatatattttatatgtgctatatataatttatacatgcttctgtaaaagtgtttactatttcatttacgagcaaaatagaaaagttgaaaatgcctgtttttccctactaagggatgtggaaatagggttgcttcaaagacacattctagcacagtttaataataattactcaatcaccacagacaggaaaaagttaatttatttggaaactcaactttatataaatgttactagtatataccaatgacagtattacataatggacaaaaggataaatatttaataagtttgatacttcaggtacagtaagtaaaaatccatttttaattacataaattctttaagtttaaagttacctagtcaaatttatctgtactgatagctgctgtcagaattacatgtaaacgcatagacctctctaagtgattatgttgtattcttctataacaatgagattcagtaaaagccgtaaatgataacactagccaataatttgattcaaccaacacaaccagaagaagcctgtgaagtcaataaaccagttccatgtcttatatacaaaaataataggttgattgaatttttactttctgaatctgttactttgatacttattctagacattaaatatattttgttgattgaatttttgcacactgagaaaatacaatctaaatatagctggagggtcttttctatttttttccaaatttttcaggcctttcattcggccaaagcaacaattgatgtggtattttctaatatctgatacagcttttcaattttgtgtgtgtgtatatatacatgaaacacagattgttcaaggggaacagaagcctatgagatatagaaaccaaaggatatgccttttaaattgagtgagcacagtctttagggcctacagtttcaaagttttgtattagggaatggctgaccacagaaatttttctaaattaagtgcataccaactagaattacacaattggcttccgttttgctacttgaagctcccaccttgagctggtttcactcacttattgttgaattatagagacagttgtaactaaatttgactcttttacctcatccttttgaaattgtgatctttcttccatctccaaatataattttgcagaccatgaccttcaacattacttctgcatcataaatgtgattttggcatcttgttgcagaatgcctactctgaggccttaattctcacatctgatgataccctgaggatgacatgtgaggccaagagggagtgaagcctcatccccactttgtgcttctttattaaccaggtaacagttatagtgttctttgtcatctggtcaacatcactaatttatcctgtgcacaattggaggatcacctagtccaactgcctccccactccacaatttgtcaaagagctaacactcaatgaagcaaagtacattccaaaaatcacacagaaaattaggcatggtacctgcaccaacacttaagtatataaatcaacgattatctagagaagcctggagtgatgggatcattgagtttagaaactaagaacatagctgtgctggttttagagaaataaagtcactattcacctattctattttccttttccttttgagtgccaacatcctcctgcagatgcatatatttatttacagagcaacatgcttgtgttagctgtttgtttctaaagtttttaaaaaaatgacattagaacttccaattttctctttagcaacccaaacacatttaaattataaattgaaatatattgcacttttaatagttcaagctttctgagtactattcagttccataaaaccattttggataggtaacttttttatttcttatcttctctaatcttcacttcaatattggaacaactagatatatgccttcttttgtttgcataatttttctttttagtgtttatgtaaatacatagaaggtaaaaattagtgaactatattcaaggaagggtgttagaatactaatgtagctaatgctgtgcttgggaactacttagggagaaatagattggtttaaaaaggaagttatagaatttaatcaatcttgagagaccagcagcatgctattgtggaactataactttagagaacatctatatgacagtatgatcaccaaaaacttcagcatatgctgccaagataatgtgcatattttaagtgcaagttagagggctccaccttccctttttgcctgtggtctcctgattatagcactcaaagtattgcatctgggtaatcctccattcccaggcgacttgagaaatttgatcccgttggtgtgaccaaaatttccaagtgaaatacagaaattgtaccgtcttcatgcatataggcacaggctggggaaaggtttgggatgacttttggctttgccctttcctgttttgtgacctacagtaaattacccaactttctgcacagtcactttgcattttttcgtaaaatgtgaataataatgcctttctcacacttattttggagattaaacataaatatgaatgtgcaatgaattctaatatgcaaagtgctatatttattaaatataagatgttttctgtaactccagcaagtttccagtgtcaatgttggtatatccaacacttcctacatgacatctgctggaggcacatgtctataactgaaagttaaatgtatgtgacttctacatgaatttaagtatgaatttctatatatttatcaatagttattgatttcacgtctcaagtcatgcttttgaaaactatttacatcaagactctattcatttgtataaaatagtttgttttttaaaaacagtttttcaagacttttataaaataatatccttttgaatagatacatacatatacaggtaaatctagatatatttttaatgttgagtttaagaagtagtttaaaaagcaaatctttaatttttagtgtgatttatctattaaaagtcctgtcttctctatattctctctacttaatgaaaaagccgattgcaaaacaagaagattgattaggggtaataagcttggtattctagtaataaaaatccttgccaaagtccaatctttacacaggacattgactttatttcaaggccaatttctaaccctatatctaaaacatggcaggggtttaatcattgtagcagatgctgtctatgcccttagtgaatctcctaccctcactcccttcacccctaggatttgccactgtaaccctgaaagataacacggtgaaaacctaactaagtatccctgactgaaggctattttctggcctaggaagcgtgctttcctccaagcaagaaaaagcagaagtgcctgagagttaatgctccccagagcaactctcaagcaattatagatggggaattgataaataaatacccatctttctagccccgttgttgagttcctgagcattgttctgcaccaccttccagtggtccccagaggaactgagatccagttgatgacactggcaaatggcttgataacaaaccttcactggcttcattctctttctgagtaacccactatcctagcaatgtttcttgggatcccaactaaacttgcattcaaatccttgattcagaatctattttgggggggatctcaaatgaagacaacaatgtttgatcagtacatcaattgacatgtatgaaaaaatgtgcacatatgcagacaagaaagcttctgcctgtctgtgtcaaaataggaatgatttgtctttctttaacctggtttatagcaactattagaaatggaattcaactaagtgttgcaagaagtccatcatttataaattaagatggaacttacttactgtactttgtctccagagattctttgagtgtaaataacatagacaaaatcatggaatattaagaatggcaaaggaactgagaactctttctcacagctatcaggttgttccagcgaaataacaggcagaccctggagatgttccataaagctggctgctgctaaggtctgctctgatacctgctatgtgataaaagttcctgacacttagcaggagttgatgtcctggtattccacctgcaaatggtaggtctgcagggcacaccaagcacgatgatattcatcctggaaatgtagtgctgagctcagaagtaagtagggtgttaattatccatgactagtcacataaaatcatgtcttatactcagttctggcctggaatgcagggtacacaaagggaggtactcattgataccagcaggagctatatgcaagcttccaaaggaacaattagtccttcagtgcctcattcaaaggctgcttagggggttgctctccttgaccttgagttaatgggagtatgagtgttcaatgaatggagattagccccagaagacagggaagcaaattaaacccctattttgatttgaattgggagtgaataaagtgttcactgctcactaaactcaagtgaagttaacatgcaggaatgaatggagactaacttctctgtgtggcaaggaagacctcaaggcagttagcacctgggaacctccagggatagagctgagacagaggtggtcattcatcattctctggggtgataagagtttttcagtaaatgctgtatcaatgtagataaatcttcctagaaccaataaaaatgccctttgccttttctatcttctgttacaagtaattgctattcaccttgttatgaatatcttgaaagtagtcacagagtacttggagtgcctgcgggatggaaagtttgaaggaaaaatgtagccgtatatcattggcattcatgagaaaattcagattagatgtttgaaaggcaggtccccaggaggcaatagagaaatcaggaacaatattgtgccaaaaataccactctggccaggacatcagggagtttatgtcaggtagagtgaaggaaagcaatttggaaagaaaagatatatgtgcttttctatatgcatttagtttatttatatgcgtacatcctctgaaaaactagtatgttctgggaatcgacaagcagattgggcctgacacttctaaaatatgtaactgtgtttatgtttcttttactctaaaaactctgaataacatcttgtaatatgatcaatactttttcaaactcatgtcttttaaaaatctgtttgcaaccaataagccaaaaatgggatgtgctcaaatatcattttacatttgggaggtcaagtttatgccattggactttacgtgcagattacaaaatattttttctttctaaagacacacctactctggtgtcctaaaaatcagttatctcattgatgacacaccagagatatatgttttttaaaatgtgggctgggtatggtggttgaagcctgtgatcccagctctttgagaagctgaggcaggaggatcatttgagacaaggagtttgagaatagcctgggcaacatagaaagaccctgtttggggcaggaggatcatttgaacccaggggttcaaggttgcagtgagctgtgatcccactactgcattccagcctggataacagagggaaactctgtctaaaaaataaataaataaataaataaataaataaataacgtgaagatgttgtggatgatatcatccttgctgggggtcactttactgcacaaagaatttcacttctttccctcttctagagtgtttgaataacagtcacttgacgacagttagttcagcttaagcctacttacttttcttcattccctttatttaaaaaagtcttatgtgtctgctttcaaggagactctcctgaattctatcaagataacaagaagaacaataactcaaaattattattgcttctgagaggctttttctataatatacctgaaatacatttaaggcactcataagtagcaaccaatcacccactcattcattgaataaatataagttagtgcatcatgtatacaaggacacatacacaagatcctgaaaaatacaccaagcaatatgccgaaaaaggagacgtgccgcaaatattttgtttattcattaaagataaattgattagaagttgaaaggaaagtggaagtacttttaaatgaaggtttaatgaaaatttcgtagaataaggtcatcgaatcttgacaatgataaaaattagagaattccaaggagatggaccaacataaacaaagataagacattcttcaaataacttgatcttttcaatttggttgttttgtacttacttttgtagtaataataataataatagcagctagtatgtattgagagtgcagactgcctataaaatattgttctaagcaggttatatgagtaaacttatcctcaccttaaatgtggaaagtagctaccattattagccccattttactgatgaggaaactaaggcacagaagagttaagtaactcacacaaatccttcacctagtgagagccacaggtcagatttaaacactggcagcctggctgtatagcatggactcagctgtgactgccccctcttgaggcgctcatggagccagtcagtgactttattttcttttccattttcctacagacatgggtagactgacaaagtcaatgctgtcttggatatgtgagctcagggccatgcaagataaactcctagattaggttggtagctatgctctagaattaggacttctgattacatcatgcagggaaaaaggattactgttagggaaacatgtgttctcatattcttctttccttcctcggatcctctaagtctaatcagtagccatcaagactgaagcaaaggcagtatctggagcaacagcctgctgtggatctcactacagcccttcccttcctggatgttttctcaaaagtaccttcacaatcaatcggcctcctgtgctgtaagccagttaatcttttttttcagactaattccaaatacatatatccaggtagctaacaataatactgtgcttcctgtaaataatatggaaagaccactcactgtgaagtcaaaagatctgggtacaaggccccgatcgaccatataacgtctatgtgcttttgatccgttacttgaagtagtgttatattacttggaagtcggcctcctccttttggccacagcatctcgacttttatacttgtcgttactgagttgcctgctctcccatctcaatttggaaatctgagaccagagttgttgctccatttactcaactaatgttgctggtgatagatagtagggctgtcacggagtcctttggattcctggcccagtgttctttccactgagctagtctcctacagtgtgctctgtggaacctaagcccttggggaagctctgcagaaggtactttttcttccctctaaatgtgattttagcatcctgacataatcccctccacactgctagtagcccgtgatactcttgcctagacctggatacaaattaagatcacagttttgtcccaagtcacctacattcagagggtccaaaatgtaaaatgatgcttttaaaagaatatgaagaatttatcctctgtggttacaggaaagttagctaatctccctgaacctgagttttgttttttttgttttttgttttgttttgttttgttttgttttccgggtagtttaaaaaatcaaatgagacaatttatttaagaaagcatctttcacattataaatcagtttacaaaagcagggtactatttatataaacatgaattccagatattggaaggtggcaatgtctgctgttagtaagaatgcaggaagcacacaagcagtgtggaaaaatcttagataatattttagtcccctgcccttggagaaatgtatcatgaggtcagtgggtgaatttctttgcctgcaaattgtatctcctttggatacaatttgcaaagggctgaggaatgaggttggacccccatgccccatagcacaaagtatttctgctcagcagtcatgtattttgcaaaaataacccacccacaacgaagtattgcctgatttaaggttctgcaatttctaaaagccagggcacttaagatactgagatgaaataacattccctgttcccaaatgaataatgcattttctcactcttttttatttttattatttcaaaattcttgcctctcttttgcagagaaatttcccagagttttacagcatcactgttgacaggcaaccacattttcctcccaaggcgactcctatttctgtgaggtcaagattgacaatgggagcacatatcaggggatgggttgatggaagagaaggcaaaaggtccaattgtccaggggctgggtggggaccgtgaaccttagccaacagaaacagaatggaatcagtgtacatcctgctgtcagtgctctgtgattattttcccctttccttctcctaatggataagcttggaagaaagtgcattctttctcaggagagagctcagaactgcagggttttactgtatttattgtgctacatatacatatacacacacacatacataaatacactgtatatacactacatatatatattagtttcaataattctttcctaggtaggtcagaaaattcacattgctatgcattattaaaaagaagttatgaggccaggtgcagtggctcacgcctgtaatcccagcattttgggaggccgcaggcgagtggatcacctgaggtcagtagttcaagacctgcctgaccaacacagtgaaacgagtctctactaaaaatacaaaaattagctgggcacggtggtgagcgcctgtaatcccagctactcgggaggctaaggcaggaaaatcacttgaacctgggaggcggaggttgccgtgagccgagattgcgccactgcactccagcctgggtgacagaaccaaactctgtctcaaaatagaagaagttatgccatcgtgtgtggttagagagtcactgattggcatgaaagcaattaaaacccacccaattttcctgaccacttttataagacagagaaaatttaataagttaatcccttatggatatcttgggctctttgaaatttagagagctctattacatcctttattaattgaccctaaaaaaattaggagcagtctgtgtggtaggtagtatggtcacaagatttacagtgggcaacccaagaacagagattctaagacttactcaaactacattgttagctattgacacgattaggactctaagacctctgttattcttgtccatggctctttccccttgattagactttcccaaagtgtgttctgtgaagcgttcactgttggaaaagcactacagaaaaccgaatcccatgatcatggaagtttgggaaacagtgcaggctatacccctgtcttcaagttctgtaatgtacactggccctggagagatacagaaatcctgcaggaaaggaactgttttgccttatttagccttgcattttgcatattatttagctgcatggtgctttttttaagccccataaacacactgtaggaagccttaccctgtgccatctagctttataacaactcagggtgggagtcctcaatttgcacctctaataagtagaaatgtttctctttcaaatgttcagatttgagcaaaatctcccagagtaagctttcggcaaaattgtaaagtctgtaagattggccatcgggatgaaaaacatggactcaggattctgatgatactggtcaaatgagggatttttctgccacttatcatctgtgtgcactttgtccagttacttagttcctcccagtttcagtctcttcacctgtaaaatgaaagcaataattgtatacctcttatttgactgccgtgaagatgaaatgaggcagtgcatgtaactcctggcatagaatctcgcttctgttgggtatttgaaaaattctattattactattattctcattatcttccttttcagcctacctcctggcaccccattctgtctcttcctcctcctatttttctatcttgtcacacaatcttaaaggactctgcttccagctatcttgcttacctggtatagtgtagagatggtatacacgatgccttccaagactgggcaggtaatatgaaagagtgaagggaactaggtgtgagacaatagggggtgtcccccaaactatggcaaacacttgtgttaaagggccagtcactccggatatttgttgttgttaatgcctttttgttgtacttttaccgcatggaaatatggactagtgatgccaaattttcagataattaatgagaagtcaaatgtttatttttatatgtaattttccaatttttaaacactctttttaagaatctgttagactaccagttgatgacccctggatcaggggatttttagcatcctgttcctatatagtaataaagagctgcaaatttagaagtgtttaagaggtcatctagttgaacttcctacttgatcagaaatattatttataatatactagaaaaggtgtcatttatctattcctagtcagagagaactaagcatctcatggaaaaaaacattacactttgtatgtacaaactcactgaattctcttatgaacctcatgaggtagatgctactttttccattgtaattatcatgtcatccaggctcagaaaactaatttacttcttctaaagtcacaaagctattaagtgtctggtagattttaagaatggaattccagactgtttaggtttcaaagccagtgcacttaaccactggctaaacaattctacttgttaaaatgctcagggctgatattaagctgaaatttgctgccctgaaatgtccactatttggtcccagttttgctctcctgagacacaaataataagtttaatctttcttccacaagacagcccttcaaatatttgaagatgactctcctctgcctgctaaatcctctcttccccaggctaaacatactcatttcttttcactgaccctcataagtcatggctttcagccacttcatcatccttgcactgctccccaggagagtatttcaatttgtcaaagttcctcttaaaccgtgatgctcggaagagaacacaatccctctgtgtagttacacaagtgcaggtcaggatggaactagcacctccctggttttggccaccatgcttttattaatgcaacctaagtcatgccagatttttagcaactatgtaaaaagaaaagcaaacattgaatattggtccaacttcacactatagaattttattctctgctttttttttttccaaacttgaattgaaggaaagccacttttactcactctactcctacccaatatatttaagcaggtcatttttaaaactcaaatacattacttagtatatattcttattaaataccatctttatttatttactgttttggccgatactgatctgttttgttttttctttaatttgacaattatagcaaaacagaagagaaagaaacattttctgtagtgtgaccactttttcttaaatacattaaaaaagggttttttcctctaccactctaatattgctcacagataaatctatttatattttcccaaaaacaaaattttagaaagtgctttgcacacatttctgttttaataggaccttgctatattattgctttgtttagttttttaaaaaatttggaatatatgaagaagcaaaaacactgaaaaaatctgctgcttgccattttacttacatatatgtattatatatctatataattatatgttatatctatttgtatgtatgcatctaccttttcattcttttcattccagatatttccgatttctgctatctgatatactcactatctcttctagctttctgtgattctgaggttaatcaaatattcagtaggattgggctgagaacttaccactagaaacttctctctaggccaacctttagcccaggggtgggaaaactatggccatgaattaattattcttcacctgttttttgcaaataaagtttttattaaaaaaactgccacttccatttgtttatgtcttgagtaagactagttttgcattctaatagtacagtttagtaatggcaacagtgaccaggctggaagtatttgctatctagtcctttatggtcttttacagaaaagatttcccaatctctgctttagtcattagtaagtagtccctgcattctgttattgaattcattgctgagaattgaaactagcataaattcctatccctgtactaaaccgcactgaaagcaaaaataatttagctacttgcttcaggaaattcttgcttctagaggacaaaacttacttttcaagaccaacatcatcatctgtatcaagagcctgaccttcttgtactcatcaaattaaaactattatgccctaatctctacccacatttaatcagctcctcatcttgcaagaacaaccttaaaatcacctaacccaggtcacgaagccctaaaaatattgttttaaaaaaaaacttcagctgaattaaattgaaaggagtttaattgaacaatgaacaattcatcaatcaggcaacccctgattctggggcaaaccccagaatcacagcagatttggagagactccagggatacctcatcatcagaacaaatttgtagaaaataaaagggaagtgacttacagaaatagaaagcgaggtacagaagcagctggattggttacagattggcatttgccttacttgagcacagtttgaacactcagcagcgtatgactggttgaaacatggctgctgggattggccaagactcagctattgtttcaggcacatgttcctaagttagattttcaatcttgtctacctattaagtcaggttactgttggtcctcaaggactcaaatatagaaatatgtatttcttcaggccatttctagtttatattaacaatatcacccacttatttctccttctgagaaagtattacaactatgccaagttgtattctccctgactgtggaaagtctagcaaacttagatttgtccaatgaataagtatttcttgtcacctttttaggaacggaaagtcaacactacaaatcctcaaagctatagcagcgtcactcatccacattcttgtattctgatttatataaatacaaagagcatttctataagatataattacctgcatattgcagatagaaaaacaggtgcacacagaggctggagctatgctttggtgatgtgtgcagtgccccagatcaagaggtcacatagtagggggggaccctcaatcagggatctgccttcaagtcccaggtctcgttctaggtcatggactaaattttatttagttaactatcacctatatatgtaaataatggcaactacttatctcctctaggcctcagtttcctcagctatgaaaatagaaagctgacttctattatctatatagtttctttcaattgtgaaattcactgaaagtatgatttttcagcagtcttaaaactaatttcttcacactagtatctttcagcaagacttcatggcctcaagcaaaaggcatatgagagatactctcttgatgactgagttaagttctacagcttggtttctctgattaaaaaaaaattgtagaaatgattctgactatttccataacaaacatatttgcatttatttcatgctgttaacaacttaacatgtaatcatggctcctctaggaaaagcagtactgcttcttctatgatcacattaaacacgctgtgttacgtctttctactaatctatcatctattatggctgcctattttgagagcttggcataacaattatcataagtgatagcattatattctgaaaacaaagaatttgatggcacaatttatcttgctacttggcctaacttaatggtggtggggtttcctagtctgtactatatttttctcagatcacaaatagttcactttttaatttattattgatttagcttaaaagtaaataactccgtgaatgctaaagttggaaatctgttataaaaattattaaaaatcttctcttccttctggccatggatgtttatcacactgaaatcaaactgtggagctacctgaacaaagtgaatttgagatttttaatttatctggtgtaattaactggtcaactaaaaacaaaagggcaattagtgctgcacacatttgttctgatgatgaacatggcaactgaaaatggatcttgatcttcactatgaaatcctttagtatcaaagcaatgttgctgtaaataaggggagaacgaagcccgtgaggagtcacgcacttgcaacaatgatgtcctgataaactaaatccacaccagtaagacaactagagagagaagttggccaatatttcaaagtaatattcctccttgaccattctactgccctgtacttgaacagcaataaccaaagccttttagtagtagtttctacttttcctgctaccaatgtgagaaaatcatttcatgtactgcaaaagaggtaagaaaaaggtataatttgtaattgacctgaggatttccataaacagtatgtattaatgcacataattctccagcgtccaagtccatgtaacctagatgtatttatagaaattaaaaagcacaatgttgacagaattggacaagaataattttctattttcccccaccatagagtaagatgttttaaattattttagacattctctgtagcttctaagttaggttgggaagtaccaacccttcatgagcacctttcagaagcttattacagagctatgcatgcacatctactctgcctttttattcaagaaattgaccctagttctcactggaaaaaataaagttggaaaactcctctgtaaaagatagataagagaataacagaggtaccatctctgtttaggataactctcattgtctctcaagcctgccggacaaaccaaggtttaacatggcagccaccttccagaattttcctgatgcctgaggtccagccattatttgacttacacatttattcctggtttactggcaattgtgcacatttatagactgacgaatagttttagagccaggagatggagtgagtgacaattttccattcctaaaaaaaaaaaaaaaacatgattattctgaaccaaacaaagaaactcttaatgttgtttgggttaagcataattagcactgtgtataacctcactgtcacagcaataattgctgagttctttcatctgccttctgggatcagaagcaagtcagtgatacatggtgagaagaggtcgtataaaggcagggctcacagtctgcagctacttcaaaatacaggactgcatctttttctactacatagatggtattcttgttgagtacgtatacactgaattagaaaaatacagttggataatcctttaacagaaatcttcacagccaaatatattttagagtttagaattcattaaacgagagatcagcaaaagaaaattccagaagctcgaaagccagaaagggtcagataataaatattttcagctttgcaagccatatggtctctggagcaactattcagccctgcctttgtagcactaaaacagccatagacaatacatcaataaacaggcatgttgggttgcagtgaaattttatttaccaaaaaaaggcaaagagccagatttggtcagcaggctatggtttcctgacccttgttttagcctttagaaaggcaatggggtacgaattcgtatgtatttctatatatttataaatttgtgtgtacaaatttatatgtatttttatttgcatgcatatacatattatagacagatatgtacattaaagatacatataaatttgtgtgtgtgtgtgtatatatatatatatatatatatatatatatatatgtatatgcccaatgaacaatacacttatcatcaaccaacatctctgtttcagcagaaaaatacatcaatatttataataagctgggtaaaaagatctaagcaaccacacattgcttggtgtgtattgcctggggacagttctctgccaccaaataaattttgctaccaagctttcatgtaattttcaactttcagagattctttttaattgcaagaaaagtgattatagacctgtacatactctttccttgaagtgtttgaaattattacttttgtactgagcaatttcatgcaagaaaaagtaaatacacgttagtttatgaaccaagatactcactgctctgggccaaattatcatttaaaagacctcatctaaaacaaaatgctggtgatacatttttgagactctttttaggttctagaagtttctttaagttagatttatatactggttttcctttattacaccattttgcctcaagtgacctgtaggattctaggaacctagaattaattcctgtggctattttgcatgtcagtgactagcagaaattttactcactgaatatttctactcgattctgctgtgagtaaataactacacttttcttaactacattgttgtcattgagccagagtattctccttcctcaggcaatttaaactttcacaaatgaaacttttacaaatggcaacccatgcataaatattagctatttaggctagcagtatagaggaatgccaaataaaacatctttcgggctttggcctcattatagtatgctgataagcaatcagatgataaagggcaacatttgctatgaaattatacactggatggaatcaaaccatcttagaatattagagctggaagaaacttgaaggtgacttctaggtcaaacccttcaattttcaaaggaggaaactgacaatcaatgtgattgtacatgaatcactcaatgttactcagctggttaagagaaagagacaatagtagaagcaaaatctctagattcccaatgtagcctttttctctgtaccaccaggttgttcagctgtcaaatgcaaacctagctcatgcttgctgaatagctatgagctctgcattagacaccacgccgagtattacgagtaagtgttacacatggtgtttatcgtcaaggtaaaatgcaaaacccttggcttttggagtctttggtaagtgcaagccttaagagaaatacattgagtcagtgtgctctagaatctttaagagaaacttcatataaatttgagataaacgatacaggggactgggcactgtggctcacacctgtaaccccagcactttgggaggccaagatggacggatcactggacatcaggagttcaacaccaccctggccaacatggtgaaaccctgtctttactaaaaatacaaaattagccaggtgtagtggagtgtgcctgtaagcccagctactcgggaggctgaggcaggagaatcacttgatcccaaaaggcagaggttggagtgagccaagatcgtgccattgtactccagcctggacaacaagagcaaaactccatctcattaaaaaataataataataaaaaataaaaaataaaaaaagaatgaaggggcttggggcttgtcggattacttaggtagaaggagacaaaaacaaaatacaaacaggactaggcaaaaatttgtcttcttggctcaggtaagatgtttcatgattctacggtactgggtatgattctaggttctttggatgatggaatgaatcacagtaacactcagatacagaaaaagcagaactctgcttcttacagctccaaatgaggcaaagggcacacaggaaattgtacccaggaacagaactacagcaagcggggactgttggaggtagcttgcgaatggaaaatggcatagagatggctaggctttgcaggcctccggaggattgggtattttaaataattttctagcccaaggaagtaggggctgtttttgggtgttagagatttggagatctgtggtatttgggtctatgtgtattataacccaggattattaaagcctaataagggatatatttggggttgagtcttagcaaactgtccatgaaggggaactgaaagtttttagctgtagctgcaaactttcgtcaagataacagttgtgagatataccagatcaacgggtttattatctcttgatgacttaatggagagattatacactttttctgataatattgacagaggtcctggcttcgactgccattggtttcaattaagcaatatgctgaattttttacaaaatattatagccaaagaaatagataactgattgataatgacctggtcatatgcttgtccctggagcaagaaggtggaggcaaataactccccagctgtattgtctgatggtacatagggagatggttcctcaaaagaaagtcacagaccttttatcacaagaaggagacagaattattgggtaaaaaaataatgaatatccgttaaataagtgtaccatgtaatttacgttataagctgaggcttttttgagaaaaagagtctattgataattctgccatgacaattggatacatggaaactgtccagtgaaaacaaagatttatggccatgctaccattgtataggtttttagggagatacagaccctaaggaggaattctatgcaaattaaatgacatctatatagagataatacataatgcacgtgcacaggaagtagatctttgtcactagattggaaatatttagtagtagtctccttggaaaaggaagattagaaacctattgtgcatagtcttgaatatcattccaaagactttggatgtttgtgaaattgaaagtgattaaagtctccattgcataaactggcataattggaccaatctttgttttaggaagaaaattttggtggtaatatttaaatgagtagaaaggacaagagatttaaggcaggaagactattcagagatccaatttttttttaatcttcaaagccactactctatttaaaaccttcattattcctttcttgtactacaaaagtagcctttaattactctgtataattccagtttttactccatctctttcattctccacggtagccagagatataacataaattttgattctgttctgctcaacattctcaattatgatctgaaagtacagcattcatatgcattaacatgacctaaatgtcttgtatatttcagcctctttccctttctccaaccttgtctcatgccgcagttcttctgaatatcaaaccggactttctcatatctttgaacaggcaactcaaggcttgctataggacctgagcccactgtctctcttttgtttaggaagctagtctcatccttccttcatacctattgtaatccctacagctctgctgttttcatcccatgtacacacactctttgcctggcaaagagctactcatatttcaagcctcagctaaaaaatgctaactgaattccaccctataaatctcatacatattacatttttctttaatattatcatatttactacacaaatattttcctgtgtgcgtaaggttttttttgttttgtttctctgtttttgttaaatgtctcacaagagaacagtgcctcaaaggtagaaatgaaggattttaggctcaccattaacaccatagtgcccattgtcttgcaaagaatgtgattatataaagaaacaaacaaataaataaatgcttatgaaaatataattaatgaatgaatagatataacatatgatctaatttatgtaaggcattaaaggctgtggtatcaaaaggaatggaaagatgatgtcagatatgagaacatttgagaaaaacattgactcaatacctatgttgacccctgaatattgtttatttttcctgtgatttttatcctttgattaaatttggaaagcatttaacttaaattttatttaaacgttaagtataatcaatgtttttggtttaagatgaagtaactcatgacagaaagaaatgatttttacaatttaaaaatacatcaagaaataaaaattttattatttattatcatcacacttaaactccatacacttccaataaatatttaaggttgcaagaaaatatgtttccactatgttaaagtttccaaaggatcttatcacttgatatataatagttttatcaaatgtaacctactacatctcttgatagaaaagctgcaaaattataccataaaaaggccatagaaataataaaggcaataatagtggctgtttttgtaaacaatcaaccatagtctgttacaatcatacagttcataataactgagcttaattgtcaagattaattgttgagcttacctacatgagttgttacagaacatggacatagataagtttattctgagcttattctaaatttttatgagtttaggagtttttatgaacctcttattagatttctcttttgggctaaaggccaaactaacattttatcttgatttcatttatcactgcatagcttaaatgtcaaaataaattagagaaaattatgatgcaacccccttaggaaaagcaagtctcgtacctgaaagataacactgctagaaattgatttcttgcagaaattttgcagcacaatattaatttttctcttgtgatattaggacaaataatgttttctaatatttgaggtgtgaattgaaattaagaaaatatgagctgacattactggaactcgcagaacaaatgtatgtgtagaaagcatccatttaggttgctttattttggataataatattaatattaaattgaattaatatgcaacaaaaatatgcttattaaaatattcgtgtttgtacgtttttcatttcatgacaattttgtctttttcagactcttgagatactgactggaagatagactgttttgttccacctgattgtatgggagaaatttttgaccttagaaagtggaaatgaggttgctatggaaactggtaattctgctgccactcataaactcttctgcaggtaaagtgttctattattataagttttgattgataaatatattggcattgtatttctttctatgggtgaagcaattttcaaaatgcacaatttgtatgttatttgaatgactaagtgataatgttttgaaggtaacttctatgactcagacagggaaagtttaatccttaaaaatgtatcaaatgccagttttaaatggaaactaacattattacatttataaattggcaaatatgacatttttatacaatgtaattatgtaatatttaattatataatatactatgacattttaataaaagaatgtaattaaatatttttatcaccaataaacagtgaataattattcttattttcattatagtgaagtctttaaaaaattaaaattaaaatacatatttctctcatgtttagaaattgatatggcaaaaaaatcaaagctatattcatttagaagaaaagatgatatagaatgttacctcagaactagaaataaccttagatatattttctttttaattattttaaaagaatagacaagaacatgttcttttattcaacttgaacatattaatatctgtgtatcagttaacttttgctttgtaataagccacgccaaatgtgagtgtaataaaatatcaaataatcatgtatttagttgacaaatctgtgggttaacaacttacgatgggctcaaatgggtcttcttttggtttttgcctgggtgcactgcaacttcgatgagctgagtcatctgagacatgactagtctagaacattcgtaactgagacaactgtgctgccatggctgtggtccaaatgttaccctctgtgagtctgggttcttttacatggtggctgctcagggttccaagaaaacaaaagacagaagaatgcagcatttcttgatgccaacgcttggaactgctacattgccatttctgtgagttattttgacaattataagtcacaagacaagttcagctttaatagatgtggaatgacactacatctcttgatagaaaagctgcaaaattataccataaaaaggccatagaaataataaaggcaataatcgtggctgtttttgtaaacaaccaaccatagtctgttacaatcatagagttcataattactgagcttaattgtcaagattaattgttgagcttacctacatgagttgttacagagcatggacattgattagatcatatgattatcaaagaagcctctcttctaccataccatgcttcttccccccgactatgtgttgataggtactagtgaagtttcacgtacttataacaaagcagtaatacattgacagacatgcaggaataaacataatttaaaaggcagaaacacagtaattgtaaaggacatatattttatagcaatcctgagaaatagatatgctgatcttaaaatgaatgagaatgctaaaatatgcagaaatcaaacaggagaatcagaaaaccatacaaataaaagcaattttaccactagcaaagctagcagctagaagtgccatagttatatttactcaaagtgattacagtattttgattggtgacacctctaagtctctgtaacaaagatttggggttaaataatagtgtattctttttttggtaatagattaagaaaagacagagaaaactcatcaaggtgcccccaaatcatatatgtgtgaataagaattatattcctacccttaagtttcatcttcctgtcaaaattcaacattaacattttgccctttaaatatgtatattgaattagcataggatctctaaaagaccttttgtgttaaattaaaatgaattattagtctcagaacacgtatcaaatctgagaaatactccagctcttatattaacttttatttatacaaactggatgtgattcaacatgtcctgttgctttattctgatgggagaaatcatcatatacccttggtgcacaatttcattgtgaaagaacagattggatctattaagtagccatagctacttaaatgagataatctaagctaaacattgctccagaggtaaggatgttgataatgacatacacaagacaacactgctttaaatctgtttgttttgttagacgtttcatggtgtgtctccctattcgcagatactattttagtttagaaaattagattgtctgatgatagagttctgtgactatgcatagtgataatatcttgtttttccaaaacatactttttattcattctgaaatgccagcaaatctttcacaattacttactttttccttgctatttgaattattataatttttctaacaggttgatactttaaatctccctagactctaaattaaaacttaaaattttttgacaacctctcccctcattttctaaaaattaactacaacttctagtgcttttactatagtcatggcctcataggcctttacaatgaaacttaatccatacagtcatacatgattgattctgggacacttttaaagttttgagtacttaaaagtttaattgttctattttagtatttttaaaatattagaagaaaatgaaggcccatttaattaggaaatacagttaataattatatactttttaactgtttcattgatatgcatgacaggctaaataatggccccaaaagatatctaggtcctaatacctggaacctgtgagtgctacttgatacagtaaagtggattttgcagatgtgattaagttaaagatcttcagatggggagattaaaatagccctggactatccagattgtaagaaggaggcagagttagacctgacagaggggaaggcaatgaggcagcagagcagagggagacgtgaagatgctgcactgctagacttcaggactgaggaagggatcatgagccatggggtgtgatgaaggaagctctagatgctgggaaaggcagggggacagattctcccctctatctgtggactgagcatggctctgcctgcaccttttttcagccccgtgaatcccattttggacttctgacctccaggactctaagaaaataaatatgtactgttttaagccataacatttttggtaacttttatagaagtcataagaaactgaagtttcttcctcactatgctttaagcttccagatggcagggactatatcttgctggtacttggtagggattcagtaaatatttgttaaatgaatgaattaattaattaccaaaagttaatgttgtttgttctatttatgttatcacagtagaataaatttagtcatataatatcctctggggaactgttagtctggttcattcctttatggttgccagtgtgtattaaagttacagtcataagtttctagaaatagaattgtaataacgttttaaaagttttaaatcatgccgtatttgaaactctgtgagggcaggaaatttcatctggtttatgctttactgattctccatcccctaatacacagattctaaatatttgctaaatgaataaaagaaagcagcttcattcacttcaacaaatatagaaatatattagaaactatgatgtgccaggcaaggagcttgatgttgaccttcaacaataggtccatagtccctgccctcttcaacctgacagtctaaacagggaaaccagcaagtaagtccacttaaactgagattctgccccttgtgacaaaaaagttcttgactaatacagctttaaaaatttggttttgaggttgagttagtaacagaactctgctgggataaatgcttattcactaatgaaaatgaggaaaagagcaaataaaagaattttaagaagtcacaataattcctggaaggaaaaaaaaatcaagaggtttaatatagactaagaacgtttattctcagccctgagttactgaaaaatctacatttcttaaagtagaaaaaatatgttaatgagataatttggataaccaaattaataaacggagaaaaacttataactgtaagtctactttttgtctttgtagacaatgcacagattgttttcatgaggaaatattttatttatttatatatttgtttgtttgtttgtttgtttgttttttgagatggcgtctccctgtgttgcccaggctggagtgcagtggcgtgatatcagctcactgcaacctccacctcctgggttcatacaattctcctgcctcagcctcttgagtagctcagattacaggcacgcaccaccatgctgggctaattttttgtattttagtagagacagggtttcaccatgttgcccaggctggtctcaaactcctgagctcaggcaatccacccacctcagcctcccaaagtgctaggattacaggcatgagacatcacaaccggtccagaaatattttattttttaataaatactgaacaatgtcagtaatgggtagaagctgaaaaaccacgtagggtcaaattttgttgaccctagaatgtcacctgcctaagaaacccaagattaactgatgtgattaactgtcacattttcccacagtgaaaaattctcagaatgcacaagatgattctattttattaaatctttcaccttaccatggcttttatgtacaatttgaaaaatattagacagatttcaaaatttagttccaatctttaaaaatttgataattattaaaaatgtttaataaagacttgatgataataggttgaatcgtgtgctatatctgttcttatgagttaaccagggttagagatagcacaattttatctgcggactattagaagatctgcagtccttaagaagagtgtcagtgagtgtcaatggctgctattataactcaaacataataaacaatagcagaatagtagttacaaggagtgtgattttcctgatactaaatattcatatcatcttaagaatttctgcctaatgtattctcttttaacattcttattttaactaagtactactatttaaatggtagtttataaaacattcacttggttcataaatataaccacttttttgtcatttgtgtttgttttgccatgggttaaggacttttatatgtattttatgaaattacggactgaatacctatttggttagtcctgaagaagtaccagttattcagtatgagacttggttttatcatgaagaagtgcaataattcaagaaagtcaacatagagctagtcacatgtattggcagactagaatcaaagccctccttgagggattctaattattgtgttatgccaacagggcctaatgagctggtttctcctactgtattaattactcttgaagaataaactgagactcaaaattataataagtctttgcagccatcatttttatgtaatgtttgctgacaaatgtggttatattattttcaaaacttctcccaaagtagttgacttttaacactaaaataaagttgtttttagggctgatacccataaagaaagaaaaaatctattttgtcagtatttttacatagcttacttctttataaataacacagcctgaaagtgaatctgggagaaactgtcactctttctaaatactcacagtcaggcacctaggaaaaagggacattggaaagtatttatgattgcttgaatttcactctatttcaaacatagccttttattgaattgagaggcagagcaaacgaactacctgagagagaaaaccagaagaatgaaaatattcactatgaccaagatttcttcaaagacaacgatgtatcacacagcaaatccatgaaaattggcaggtgtaataaacctgctttgctcaaggatcccagaagcacatactggatattcctttgggtcagagtgtgaatgaatattgagtacgtcacaacccacactctgcctacggtcttgtttggatttattgttagcataatagcacctttaagaatggaacaccaggctgtatttttaagccaagtgacatcttcgcaatttctaatagaaatggtccaatttagaaatgctgaaaacaccattttcatgcaatgcttactgataaaggtggttatatgattatcaaaccttcttccaaagtaattgattcttaaaccttaaatgaaattgttaggactgataagaatgtaggaaaaaaaattatgttttgtcagcactggggggaaatgattggtatgcagactggcatactataggaaatgtaggctcttagttgaatggaatgtgagtaattgtgttttcaccatgaagtctttgaaggagagggtcaagtatgctatggaagtaataacaccaggtcatattttcactttaagggtactcaaaaatagctatgctatgacttgaaaatagcatggaaggattcataatatttttcttttcttttctttcttttttttttttgaggtggagttttgctcttgttgcccaggctacagtgcagtggcacaatcttggctcactgcaacctctgcctcccaggttcaagcaattctcctgcctcagcctcccaagtagctgggattacgggcatgcaccaccacacctggctaactttgtatttttagtagagacggggtttctccatgttggtcagactggtctcgaactcccgacctctggtgttccgcccgcctcagcctccctaagtgctgggattacaggcgtgagccaccgcgcccggcccaggattgataacatttttcttcccccgatttaaacaactccagatgcttaaaatcaaactccttgccattccatcaagtcacgaaacaatctggcttcttctgcctacctctttcatctctacttttacttaacttccctttgctcattgcattagagtcacatttttttcttatgctcatcaaaataccaagattgttctctgcttagggtctttgcatgtgctgttcagtcgtgtgaaacactcttcacatctttctatgactggctctttccattatacccatctccaatcagtcacctccatagtctgacgttcccttaggaccttgtctgggtaagtagtagcttatcccactattggtcctagtcactcttgtcaaccttttttactgttttcaatgagctcgtcgctatctggaattaacttatttatacattgtttaccagtgcactttctgcctatacctagaggaatataagttttatgtagttaaaatattgtgagtcgtataagtggctgcatcactgatgcctagtacagtgcctgacgcatggtacgcactcaataaatatttaaaataaatgagcacgttattgacctctcaaaataagaccccaagactgcttagggataaaccaatattcccaaacacctttagcaattgaactggttcttgttagaatctacttttaggcataaatgttttagtcacaatatatcttttgggcttaggattttttttttaatttttaaaaactatgctgtatactgaaagtagaaagctattcctaatttttgaaacgaatacagtttgcttagacacacttgacctaggcaggggtaacttcagtgtggtttgttcagggagtagaacatttaacatacagccagtgctgtttcagtattactgggtagcaaatacacgttgactttgtgtcacaaataatttaaatatttaaacttgtgggctgtattttatctcaagatgtatttttttattcctttttagttctgtcattaccagtcaagttgatccaccattgcctctccccccaagacatttgtaccagcctcctacagtttctctctattttgaggcatcctctgtgtcctttccaagacttagcttattgacacagatgcctatgcagagaaaacttcataaagcacggctgattttgtcattactctatgtcaagacctttacagatcccatctcctataaagttcaaactgtctaatcaagcattcaaattcaatttccttcaacaaatattggaagttctccaattaattcaattctacctgtgtcatgagccatgccttcccttactctccttcatgtatcctttattcaagtcagactgtgctacttgtaagatctctgcactttttaaaaatccccaagtctctccttatatcattgtgatattctgcattgttcttcttcagatccatttccatttattaaaggcaaatccaatctttaacacacttattcgaatgctatgttcattctgattaatcctcccagtaacatattcttccattttctcctgaaaccttgattctgtgaagaagaattttgtcatttccacactctttgcttagaatcaggtcatttctctcaaatatatgctcattctgagaaatatatagtatttacacttgttgaatttgtaactgtagaattcttagtcttaaagggaaaataaaaactcaactcaaatatttgactcgttatacctcataactagtgcattcgagtttataaagcactttatgaatagtgtttcatctgatcttgatagtgggcaaaggaagaaacgatatttgagtctcagactttctttctttctttctttttcttttctttctttctttctctttctttctttcttgctcttgctctttcccttccttccttccttcctttccctccctcccttccttccttccttccttcttctttctttttctttctttttttccagtctcgctctgttgccaaggctgaagtgcaatggcgctatcaaagctcacttactgctggcttgacctcctaggcttaaacaatcctcctacctcagcctcctgagtagctgggactataagcatgcaccatcgtgcctggctaattttttattttttgtagagactgcctctcactgtgttgctcaggctggtcttgacttcttggcccaagcaatcctcctaccttggcctcccaaagtgctgggattacaggcatgagtcactgcaccttgcctctttttttttttatttttaattttaatttttctgtgtacatagtaggtgtatatatttatggggtacatgagatattttgatataggcatgcaatgcataatcgcaatagggaaactggggtatccagtcccttaagcatttatcctttgtgtcacaaacaatctaattatactcttttatttatttatttatttatttatttaatttatttatttatttatgtacttattgtctctgttgcccaggctggagtgcggtggcacgattctggctcactgcaacctctgcctcccaggttcaagcgtttctcctgcctcagccttccaagtagctaggattacaggcatgtgccaccacacctggctaattttgtatatttagtagagacggggcttcaccacgttagctagcctgatcttgaactcctgacctcaggtgatctgcccgccttggtctcccaaagtgctgggattacagatataagccaccacgcctggccctgttattttcaaatgtgcaattaagttattattgactagagtcaccctgttgtgctatcaaatactagcttttattttttctaacttttattttgtactcattaaccatccccacctgtccccctcccgccgtcccagtttccttcctagcctctagtaaccatccttctactctctatctccatgagttcaattgttttcatttttacatcccataagtaagtgagaacatgtgaagtttgtctttctgtgcctgacttagcttaatgacctccagttccatccatgttgtttcaaatggcagaatctggttcttttttatgactgaatagtactccattttgcatacgcaccacattttctttatcaatttatctgttgatggatacttagattgtttccaaattttggctattgtgaatagtgctgcaacaaacatgggcatgcagatatatcttcgatatattgatttcctttattttgggtatatgcccaccagtgggattgctggatcatatgggggccctagttttagtcttagttactggatcatatggtaactctagttttagttttagaggaagcccaaaactgttgttgatagtggttgtactaatttacattctcaccaatggtgtatgatggttccctttacttcacatccttaccagcatttgttattgccagtcttttggatataagccatttcaactggggtgacatgatatctcattgtagttttgattcacatttctctgatgatcagtgacattgagcactttttcatatgcctgtttgctatttttatgtcttcttttgagaaatagctattcaaatcatttgcccattttttaatcgcattattagatttttccctatggagttgtttgagctccttatatattctggttattagtcccttgtcagatgggtagtttacaaatacttccttccattctgttggttgtctcttcacttcattgattgtttccttttctatatagaagcttttaaacttgatatgatcccatttaaagattgtttcttgacacagactcaattttttttggcagcgggcaggattttcctctgtcactcaggctggagtgcagtggcaagatcatagctcactgcaccctcaaatttgtgagcttgaactatcttcccacctccacctcctgactagctgaaactacaggctcataccacaatgcctggctaattttatatatatatacatatatatacacacatatatatgtgtgtatatatgtgtatatatatacacacatatatatacacacacatatatatacacacacatatatatacatacatatatatacacacatatatatacacatatatacacacatatatatacacatatatatacacacacatatatatatatacacacacacatatatatatatacacacacacacacacatatatatatatatagacaaggtcttgctaattcttaaactcctggcctcaagtgatccttttgcttaagactcccaagtaacagactcaaatttatgaaacagttaacctttaaaatctgaaaccaatttaaagggggaaatcacccagggccttgtaagtcatactaaggaactggattgtgttcaaattaccgcctaattaccatagtgggggcttattcatggaggatatgtgccaatcctcccagtggatgcctacaaccatgaacagtcccaagccctatacgcattatgtttcttcagtctgataacagagccagctactaagtgattaaaggtgggtagcatacacagcgggggtgcactggacaaagggatgatttcctttctgggtgggacagactggaatggagcaggatggtgtgggatgactggagatttcatcacactacccagaatgcaatttaaaacttatgacttgtttatttccaaaatttagcgtttaatatttttggaccttggttgagcatggtagctgaaactggggaaactgaaaccacagaaagtaaaactgtggataaggcgggactattatatatagaatttttttttattttggcaaatatactgtcattaattttatttctttttatcttataaaaataaataccttaatatatttatctagtataaattgacagaacaattaatctatataaaaataatctggttctcaaacttaacttcacattggaatcacttgaggacatttaaaaaatactgttactacaatcccacttagaaatttagagttaatttatctgtgttcaatgtaatcattcgtttgtttttctttttccccccctcaagacaaagtcttgctctgtcccccaggctggagtacagtggcgcggtctcagctcactgcaacttctgcctcccaggttcaagcaattctcctgcctcagcctcctgaatagatgggattacaggcatgcgccaccacacctggctaatttttgtatttttagtagggacaaggtttcatcatgttggccaggctggtcttgaactcctgacctcgtgatccatctgccttagcctcccaaagtgctgggattacagacatcagccaccacgcccggccaatcattcagtttttaatttttattaaaatccaaaatatctcagtaagtataatgtgcataaattgtgtcagttcaatgaattttcataaattcaacctacccatgtaagcagcacacaaatcaagatgcaaccatggctggatcccagaagccctttccaatcacagctgagacacagaagggtagccattatctgacttctcatcacacaatttacttttactgtatatatatatatatatatatatacacactacctatatggtcatttagtgtgtattctttcatttctggcttgtttcattcaatatcgggtttgtgagattcatccaagttgttgtgtataatggcaagtttgcttactctcattgctgggtagtacattattccattgtatgaatcttttacagcctgcctttccattctactcatgatggaccttggtgtttttaaaaggacctaagtgcttttaaaagctaagcaaatgattctagtatgctgtttctgaggttgagtatcaccaatgtagtcataaatgtacgtaaaaaaaaaaaaaaagaaaaattaatttgatatcccattaggcttccatagaatttgtggtagtgtttttaaatttgcataattctcatttttatttatctctagttgaaaattaccgacatatttagccagggtgtgctggagctgactcgtagcagctcatgaaagctgagtgttagtttcaggaattttgtaagcaagtcgtttaaacacagctattattaaaaattaaatagacatccaattaaaataattatattcaaaatttcataaatatttaaaattcattacttccaaattattttagaatattttcctattacttatggtcttgaggttgttcatatctattgtatttgtatggtggaaatatcatatcatggaaactactgtgcatttcttcccaaattatgtcatgttattatctggaaatcactcatgggtagtatttacaccacagcaactggcaaaagctacaaagcaggtcctcacttagtgttgatgctgaaagagtttcagtaatggatataatttgtatgacagtgagaaatagtctaagattatattgcatataatgatatatgattatatatatatgatatatatatatatataatgatagcaaatgcttactgggaataaagttagcagcagattgggatacaattccaattgtcaggtcatggttgaactgcaactgaagcttagctagagacataaatattcaataaaacttagcaaaagccttctatgaaaatcaattgacttatggaatttgtaattaattatgatattatatattttattatttttaattgtgggctacacatcacatccattgcattagtaaatttgataataaacatgtgtatatacatatatatacatttatatgcacacaaatatatgtatccacattcttttcagagacatggttgttaaataactgctagcatgctgctctgttgagctatgttttattttttagccatttttattagtggaagtatgccatgttttgcagatttattcggtacaaaaaacaaggtagagaagtaagtaccaagaccccatggtgcccttaggaatatatatatatatatgtatacacacacacacacacacacacacacacacacaaacatatatatgttctgtacatgtatatgtgtgtagatatatattttctatacatgttacattacactaaatgatattgtaattgttttgtctattttagcactaatttagattttgatattttatttttcatacagaattagtactaaattgaagaacaaagataacatatttggactcagttaaaaaaaaatctcaatctgaagatacctaatagtttaccagaaaacagatgaagagtttctttcctccctcataaaaaatcaaacttggtttaccgaaccttgcagctaacaacaggtgctgtctgctcactttgccagaagctcacaatagaacagattgggtacacacagaactaaaaacaacatttgagtaaggaacaaaaccctcccaaatattctgaccagctctataatcagttcttaatattgagcctggaaacaataatgatttctttaatgtcaaaatgggcaaagaaccttgtttgtattgttttgttttgttttacctgtatttgtgcacatgggaatttcagaaagcacttataatcaaacacaaaagtgctacatttggggttgtacagctcagaagggaggggaaaaaaaaccccttcttcttcgtaaaagtcttacagagaatcaccaatcacagagggagaagtgtgttctaatatcaaatctgtgtggctgcaccatcccttcttaattgccaattgtcttttccactttgtcctctttctgtaacattgctaaactgaatctgaggccagggctttaacttgatatatctaagttcatggccatacatttattttacttactcaaacacttagtctctcaaatagaattgatgatttgtcaaatgatttgttgttgcataatgacatagctgtggaagccggatcttgctttatgtttgagaacacatttccagagtccaaaagcacgtgaggattgatggcacagatgggcttgaagaactggtttcagaagtgccatcttctactcaactgccagtttttctgtttatcatctagctagacattctgaccctttgtatcctcccattgcttatatttttacaacgtcaaaatcactccaaatgagaaatgtgggaacagaaaagcaaagcaaagagtattcagaccacagaaaatcatctgtgcctagggactggcctggcagcctcttgttttctgtttgtcccttgaagacaatggaattgtaatccttgtaccaggagatcacaccatcctttccagttctgattacccaatgattctaagatgagaagcgttacacagttttacaatttcttaatagttctgatgaaagaatatatgaggacaacgcagcttgttttagctaaaaggcaatttgggactcttctgtgaattttatttatccatcttatgctattcccttgggtaattatgagtgaattgctctgtgctgtgtttcatcaaactttttctgactgttattttgaaattattatcaagagcatcactgaaggaacatagtcacaaatggataatgcttattaaactgcagtgttatatttgaatgccactattctatggctaaggttgtgctatgccctcatgtgccagccttgaaagctcattaatttgtttggttctgccagtcaggctggagtgcagtgacgcgatcatagctcactacagcctcgaacccctgggctcaagagatcctcctgcctcagcctcccaagtagctgggactgcaggcacatgccaccacacctggctaattttttaaattattactactttacagatgaggttttgctatgctgcccaggatgatctggaactactggcttcaagtgtcttcccacctcagcttccctagttgctgggattacaggcatgagctactgtgcccagcaaagctcattgattagtctgcctgtctgtcaatgcggtcaatcagttaattcagtgagatactcagacactccaaacaaactattaatctgaggagacaacctgaaacacatgattagcagctgatgtcgtaagaacataaacacttagccaatctgtaatcaatggattcatctcaatttaaactactgcttcttttagtggtaaacattgaagagcaggggaaatctgcaccaggaaacaacaagtttcactagactgacaaccttggctgagctagaactatgttttcagaatttctcttccctatccagatctggattagagatgaacaaaaaggaaatttgtgtgagatttggaaggtggaaatgatgctactctgtgaaagctgcatgtaagtttgtctggtgagaaagagacacaggttaacagagagctcgtcctctgtttccttcttcatatccaggttttggcccaactggtggcactactgaccaacattgaccttaggtccactccagttttagaggcaacagttcacaaacgcttccccttcacatgcccattctggcagctgaacttgctggcttccttgcaagatctgacttgaccacctgctccagtgcccaagagggcttgttagcagtatcactgtgatatttcccctctcacttttgtaccatcatcttctcttacaattacataaggtcttcctcctaaaatgaatcctctattttacatgattcacagtagttttgctttcctgattgaaccttaactagtatctgtacagttcaaatttgtcatacatgacaggggaatgatatccaaatcactatactttggtttttcctatgatagctggtgaatatggaggctttggaggggctatagttttcatgtagaatgtgattaggatactgaagaaattcttgacatatattaggactcagaagcctatgcaacttggcataggtattttttgtctcttcctctgtattgtgaagcctccctgtgccatttagtttttaggcagcagttcctgcttaccatccaaaccccttttgaaccttacagaatccccaaaagtcagccttggccttaagtcccacagtactgtgctttacctagggagcatgttaattcatgcataaaaattaaggactcaaggtacattatatcactgtacatctgagtggatttttttgtggcttaaccttgatttttagtgctataacccaaataaagaaaaatgcaagcatgcattggagggtattgggctgtaataaggtaataaagactgtttcagtggtatcatatatagtgctttacagaatatagggtattttcacacctcacctcatttacagttcatgatctctcatgacattattagagggtcagagatgttacatgcttgtccatggttatttgtgtggcttggaggaaccagaaaccaaccaagtgttcatatcctagtgttcatttcactgaaagatctggctttttaatgaagccgttggctcttcccattcccattctcattaccgctcatctaggctgttgcggaagactctgcaatcctcttttctcctattatcagccccactcttcctcccattacaccaataggaaatcataatagttttatgtttctcattttgcaaatgagtttcaatggtccatctgcttggatcaaacgcttcaagtgctgtccctttgctgcagaaccagatagattcttctcaaccttgtattgaagctctagcaggattccaatgagctttttcaaacttttttcctacctttcttctataaagacactttgtgctggccaaactgagtgcatcacccccactacacacacacactcacttctacaaggacttataataataataatcacaacagctacctgcattgaccatttagtagctgctgagtatctcactagttctttatctatattacccaggcaataaccatgagatgtgcattactattgtttccatttgtaatgaagaaatcaaagctgaagaggttaagtgacttactcaagataacatggcaggtcagtaacagaagttgtattttagcacggactgaattttaaaatggcactctcaaactctctgtgccactgcctttcttcgagcactccccatttcttacagtgcctgatccctctgaacacacattttcatttcttccttcccttcaagggccactccaaaatcagtaagtcttccatcatctccacattaccacttacccacagaaagtctccctctcttgaattcctacatctctgagaagatgcatgaggaaagagaagtataacttatgagtcggtaacattcagtgctcatttctcagtgcgttgcttggatcctggcatgcaggggcagctcattggcatcaactgttctaagtactggctaaacaagagacaagctctgaggcatatagtcacaaatatgggcagtaaggagttatcgtgggagtggtgaatgtggaggggctctgagtgggaaatagttcaacctcattttatagatcccacatctaggatacaaatcagttaagccacttgcccaatgtcattcagataacacaagagtacccgggagtgctgagatctgaacccaagtacacatatattcttcctgcattttgccaaacacaaggcaatttctaggcttagtggagttaatgatgagcaaaaaaaaggcacatcctagaagcttctggtcaaatggcagagatgctaagatacagattaaaattttttttaagaaaatacaagtttttaaaattgttttaaaggaatcaaactacacatctcatccagatgacagatgctactggggaaggaagcacagcacttatctatcagtagggctagggagctcttaagctgattaaggacacaggctccgcaattaaagacacctgtggcacatatacaccacagaatactatgcagtcataaaaaagaatgagttcatgtcctttgcagggacatggatgaagctggaagccatcattcttagcagactaatacaggaagagaaaaaccaaacactgcatgttctcactcataagtgggagttgagctatgagaacacatggacacgggaaagggaacatcacacaccagggcctattggggagttgggagcaaggggagggagagcactaggagaaatacctaatgcttgtggggcttaaaacctagatgatggattaataggtgcagcaaaccaccatgacacatgtatacctgtgtaacaaacctgcacgttctgcacatgtatcccagaacttaaaattaaaaaaaaaaaaaagaaacagtggttgtgagagaacagtgcagtagagtggtagggatgaaagacaaattataaatggtggaggagtggggagaataaaacaaaaacaaacaaacaaacaaacaaaaacaccttggttcatacctggcaccttactacttgtgtggcagggcaagctactgaacccctctctgtcttacatactgcatgacaaatgatacacattcaagtcacactagttttcattttttcctatcagttgccaatttcttgtactagagatctttacgggaggtcttacctaggtgttaccttccttttcacctagatgacgtatctgaaatgttgcccagatggggatccatatccaatgtatctttttactctgtctccgaagtacctaacatggctttggtaaatatcttttgtttagctagcaagcacatattaaaataatgaagtgccccgtgagtcacaatgatcatcacaaacagccatacgacatttcctatgcacttttacactcttttaatctcccaggtgattagatatatagcttaaacataccgtaagtccctcaggtgggcaaattgtattggccccattttacagatggggaaaatgagggaagggtaagaagcttgccccaaggtacagagtgagccagtggtggaactgggatttgaatgcaggctgtctcgctcctgaatctaacttcttagctgctagattcaaccgctgttcaacagagtgaagggatgctaacacccaacatatattgagcactcatatgtgctttcaaataattccatgagttaggatctcaaaataatttgacgacataggaaatgtcattctttttttcatttcatttatttattttgagatgaagtctcactctgtcactcaggctggagtgcagtggcacaatctcactgcaacctccgcctcctgggttcaagcacttctacttccctcagcctcccaagtagttggtactagaggtgcacgccaccacgcctgggtagtttttgtatttttagtagagagggaggttccccatgttggccaggttggtctcgatctcctgacctcaggtgatctgcccacctcggcctcccaaagtgctgggactacaggcgtgacacatcgcgcccggcctggaaatgttattaaccctgtgttttaggttgggctcctccagaagccgactttcagaaaaaaatatgaatgaaagtaatttatttaaaagataatccccaaaagccccagtaaatggtaagtgagacagggtgagaaaggatgaggtttgttattgagcagtgcacatctagtatgactgagactctgtatacaggaggtagtgtagaacacacctcagtgtcttatcagaatgtgactaagggaccaggaagctgggacacttgcccgtcactgccctttcatcactggcatcaactgttctaagcactgactaaacaagagacgagctctgagacgtatagtcacaaatatgtgcaataaggagttatcttgggagtgttgaatgttgaggggctctgggtgggaaatattttaacctcattttacagatcccaggtctgggataaatatcagttaagccacctgcccaatgtcactcaggtaacacaagagtacctgggggtgctgagatctgaactcaagcacacatatattcttcctgcattttgcatgttctctctaagcacagagcaatttctaggcttagtggagttaatgatgagcaaaaaaagggacattctagaagcatctggtctaacaacagtgatgctaatatataggttaattttttttaagaaaatacaagttttgaaaactgttttaacggaatcaaactatattgctgatatagagaataactcaggtggacgtgagtgggaagggtgtttaaaaaggcgtattcctggcaagggaaagccaaagtcactcatccgtggagacaaagcaggccagaatgactgatggggatgcagtgagtggcagaggaaggatggtatgaaatgaggaagaaggaagggaaaaggcagacatactagtctcagaggccctagtcatgctttaggatttaattctaaaagcaatgagaatttatcaaagagcatgcaattggcagaggatttgttcttctatttagcctaagaggcctccagattaaatgttctttctaaatacttaaaaaaggtgacatagtctaaaagggagacagcaaaccagctagaggctgtggtcaggtgtggggaaggaggggacattcagcctccttgttgtattcaaccgccttcctcagctctgtcttctcttttctgattctgtccacattccactttaatcctcaatgcttgtgagatgatccagagtttgactgcatatttagcttttcagggatactgcagataatgatgagaattattcatctttcttcagcataaaccgtatttaacgaggggctagaaaaataatataaagaggctttatggtcaagtttcagagctgagttaggaaagtaattccaagtagtagagtttcagcatattttatttcctccttttacttctctaaattttccaaatggatttatactatttttaaaataaaaatggtcaagcctttaaacatttgtgccaattatgtagatagcctgcaaagctgagacacttctcactatgctaatcagataactggctcaggctttctattttatttgataaactttggtcattctgaatttccaaatatcaccaaaaattctgactttgataaataatcaaatatttagctctattgtgtattttcttacaattttcaagtgatatgggtggcccatattatattcaccttaaattttattagaaaaagaatactttcgccggttgcggtggctcatgcctgtaatcccagcactttgtgaggccgaggcgggcggatcacttgaggtcaggagttcaagaccagcctggccaacattgtgaagccctgtctctaccaaaaatacaaaaaaattagccggatgtggtggtgcaagcctgtagccccagctacctaggaggctgagacaagagaattgcttgaacccgtgaggcagaggttgcagtgagctgagatcatgccactgcacaccagcctggatgacagagtaaggctccatctcaaaaaaaaaaaaaaaaaaaaaaaaaaagcaatacttttaatatgcttactcacactattcaaagatctttaattataatcatttaaaaactgtgaggtagaaaggacaataagtgttattctccccaatatacagaccaaaatatgggtaacgtaagctaaagacccacagttagtagcagaacccgttgaaaatcgagtgtctatttaaataacaaacctgggtgtctatttggggataaaacacccaatctctacagccctttgatttcaaaagaactgatatcccaggaagatagagaacttaacataaataagaataaccaaagtgaagcttaaacatttgtacaaaccttgacaatttcattttttgtattgtttgtattacccaagtcttatcacaggggacactgagaaccaaattaagtgtgtcaaaaatcaaaaggaaagatacataagccatctcctctgaattttttcctccttcccttgtttcttccttataaacactgctgggtacttaacttttaaaaacatgggctttgaggaaggacatagctgggtaccaatcccatctctgctctttaagaagttgggttacctctgacaagttacaaaccttgcttagcatctatctctttacctttatattagccacaatacccactccatagagtgggttttatatattactatttgtacagacttgcaagaatgcaaagtgcgtagaaagtgctcgataaacagtaactagtggtgactggggtaggggtagtgccaatagttgctttaagaacagttgaactagcagcaatggccaatgccattggcaaccaaattgtgctcataactctatggaccagatcttaagactccaacactgggaaatttgctgtcattctttgatccctgggcttaaatgtctacttcttaatgctatgagctaaatattcaatgttaaaatggacagggggtcatgctccatctcatttatcataagtgaataactgggttattttgaccatagatcaaactccaaaaatttaagcaaagaaataatatgtgtaggttccagaaagagatggggaaaatgtgaaaatacagctaaaataacccacaatttaaattttggctacagagttaatgtcctatttgtaaaccagaattttataatctcaacactgctgagcagataactaatcatattttgaaccaaataattatttgctgtgtgagcctgtagatgtttagcagcattcctgcctgtacttataaatgccacttgtgccaccaacccccggttgtgacaaccaaaaactggcttgactcccaaatccactggagcaaaagtaccttcgattgagaaccactgctctatactctttttttttaggcagagtctcactctgttgcccaggctggagtacagttgtgtgaacaaattcattgcagcctcgacctcttgtgctcaagtgagcttcccacctcagcctcccaagtccctgggactacaggtgcatgccaccatgcctggctagttttttaattttttgcagagacagagagtccccatgttgcctaggctggtcttgaactcctgggttcaagccatcctcctgcctcagcctcccaaagtgctcgcattacaggcgtgagctaccacactcggcctgctgtatactcttgactttagaatgctcataattctaaagaaccatgttgcatcgtgccttctcataaagcctcagccttcaatttcacaccatccaaacccattgaagctcttgagtcccttgacatggtaactcctatccctctcccatcagaccatctcctcatggaggtgacagacaattcaggaaaatctcccattaaatccactcccctaaagccctcttggaagagtaactatatgaactttatacttctctccctcccaactttgtacctactttctcagaggtgcttaaaaaatatcacttctctgaaccccagttctctcttttatcagtttcatgtcttcaaaaatagcaggattatattgccctctgcagatgctactggtgataaagaataaaaattgaaactgactttttatgtaacagcagtgtatcacaaaggaggaaaacaagaaagaagggaattaacaatgattaaacacctaccatgtgccagcctctgcactaagtacctataatattacttcatttaatctgtatagtgaaactttcgagtaaagttttctgagatcaaaagaaagtgcatttctgacattatcttttaaataaatggtcatttcagattgttccgcccactttagtgtaccatttcccaaaagcatccaagaatccttgtgaaaagtgaagacagtctgcaataactctctgtgtgtgtgtgtgtgtgtgtgtgtgtgtgtgtgtgtgtatcacaacttaacccatagttttggaatgtcagtcatctcaccaaaatccggaatgaactatgtcccagtggatcacatattcttgaaagggcagtcagatttctgataagcaactcatatacacgagagcaaaggcaaggttctatctatagccctgtcatgaggcaagctgtctctttttgaaaatgatttagaggcagctggcctctggtctgctagtctgttggtgtctcacttggctattcaacatcagaggcaggaatctctgcccattttcacataatgcacatgtcttcctactggaagatctttctccaggagtggagggttcaggtcaaggtctctgctcacaaaataaagacagaactcagcactatttatatcacaccagaactgactcagcgccattgcccatttaactcacttgtcttgctatttggagatgttctctctcttctggcttttctgccatctgtgacatctctccaggcataccgtaaggagaggacattttgaaggatcactctatttgtttcatcctagaaaagtttatatcagtccaattctgctgctaactggacttcgtctctggcttcttcatttggaaatctacctcttatgctaagtgcccttatatcacctggcggtttgcaaagaggtgagtgtgaatgctccagtaaaaacagctgcctttactaagctttacagcatgtgctcgatattgagctaagtgctttacgtgaattatttcatttaatcctcagaaaatcctctaaaggacaggaagtattataatctccatttagataaaggcaactaattaagataagttaacagctgccaaatttcatacaactagtacatgacgaagttgggatgtgaacccggacccatccaatcccaatgcccaaggatgttccactttatcacaccacctccctgtgagcttctgttgagattatttttttactgcctgatccacaatattattgtcatctttatttggcttggcggttgacaaaatgaatgcatttctagaatcttcaatgacgtgaaaattggattacaaacaaaaccatctctggaactgcctgtttcctgtattttccttttggggaaaaaaaaaaaaaactaaaataatgagctagacgagaattctgatctcagatatgccactacatgctcctgcacaccagagcaatgatgtacctctcgagacttctgtttctttatttgtaaactggtggggttggaattatgaattttaaattcctttctatctccaatacactgtgattttctgatgcagtgggtattactgcctcacaaagggcttacaaaatacactggagaaaacaccagtaatagaaaactctacattcattgctacttaactttgtgctcattcaaatatcttcatagtgtctctctccagagactccaagcacttacttaatttaatatagccctttataaaatgggtcttctctgcaaatctcagcttgaggcatttctctggtacccacacaatacattcgcttttacagaggctttattttttcccctaagaatttcctgttcatttagctacagccagaggtaaagctaacaaatttgtacatctcttcagaggcacccaatttactaaatgtcttttaattggcataggagctcatagaatgtcctctgagaggtcacgttaagagttattttgttaaatacaaaggtatagaggaggtattttcagatggaatctgaaactcaaacggaaattttttagcagcatctcatggaacttctcagttttcttatcacaaatgttctcctgtcagatcttctgtcgtaaatatgaccctgtagactgaacaatggaaatgacagccactgaatccatctctctttctcttttctgcatttaaaattcaagattataattgtagtacaaagtatgattagtaactatcagtgtgaactttggagtccacactaatctcctaaaatttcagtcatccattcaacaatactcatggcttcacccacatgctcacttctgtgtcccttaaatcagtggctgacacataggaagaacccaatgaataataatgctaaattgatatgccaagcactgtgctacaggtaaagcactgaacaaagctgacattgccccaatccttaaaaagtttatagtccggaaataattgtttattcttatatgcatgcgcccacacacgcgtgtgcacacacagacacactcccaagcacatctataatcagtgtattaaaacaaatatcttggcagagtgtggtgggccattcctgtaattccagcatttttggaggccaaggtgggtgatctcttgaacccaggagtttgagaccagcttgggcaacatggtgagaccccatctacaaaaaacacaaaatttggccaggcatggtggtgtgcctgtagtcacagacactcagggagctgaggaaggaggattgcttgagggtgggaggcccagactacggtgagtaccactgcactccagcctgggcaagagagtgagactttgtctcaaaaaaaaaaaaaaaaaaaaaagacatatctttaagagcatgtaaaaggaaaattccacttgatctaaggagttcaaataacactaccataaaaaattgactttctaactaaaatgtgaataaaattttaccaatgattagatacagtggagaagaggcatttagggtataggcaaaaacaaacaaacaaaagatcaaagtgaggtatgggagaaaacacagtctactcaaggctaacagcaggttagccaattgcagatagcaactgggagcacagcagatgaggcagcagggagaggcagggaccaaactatataggactttgtaggtccttttacaaattactaaggatactctactatattgtaaaacaatatgaagttattaaagactttctagctgcaagagggcagtagagcaggagaggcaaacaacaaagacattatctgatttgtatatgcaaaagaccccattggctactctttggtgaatatattgtgagagtggaaagaatgagaattaaaaggcagtcatagaaatcaaagccaaaatagcaatagtgtgatgcgggactcttgctgtagcaacagaactatttgaatagatttaggatgtaattgaagggttaaaagtgagacttggtattgcattttatatagatacaatggagaagaaggaatttgtcaaggaggactcttaggtgtctaacctcagcaattggttcactggttgtggcattttctgaaataaaaaaggagagaactaaatctggggtgagattgtaagtgcttccttctacattttgatttgaaaagctctgagtttattgtccctgtagaaatattgagtacaaacagtggatgtttgtggaataaaaagaaggaaaaggagtcagagttgtgatgaatttgggaatcaccacaacatgtataacaaaatatagtagaaatattgggaggccggggcgggcggatcaactaaggtcgggagtttgagaccagcctgaccaacatggagaaaccctgtttctactaaaaatacaaaattagctggatatggtggtgaatgcctgtaatcccagctactcgggaggctgaggcacgagaatcacttgaacctgggatgcagaagttgctgtgggccaagatcgtgcaccgcacctgggcaacaagagtgaaactctgcctcagaaaaaagccccagatcaaacttgaggctgtttgattcaacctggttagccgaagagagtggctggtagagaatgactagcatgcaacggtgatggagaaatattagccacaaagatacgaggcaaactagggagtatggaatcacaaaaagcaaagaaaaagcaagttttcaggtgagggaaaaatttataactcttgattattcaagtatatagagaagttaaaaatatctacaggtatcataacaagcatgtcacctacaactttagttgaactatgtctgtttatttaagagataagtaaaattgaatttactaagtggaaagtgtggaaatagaagcaatagatacagacaacaattcatagatagatgtttagctgtgaagggttttaaaatgtttatgctaataaagtattaatgagtcaaaatgtactacacatgatctctaaatatcactccacagattatttcttcattacaagcagagtaaaaggcctcctcaatgctaagaggtgcactttctactacaaccaagtgatcaaattttgcatcactcataatgagaccaactgaaataatacacctctggatgacaaaagaaagcatagaatattactcatgtccttttcttgccataatgtttaatcttaatctaatcctgaggaaacaatcacaaagttccaactgggaacccttctccatggcctgggatcttcaagaacgtcaacgtgataaaagtaaaaaatgtgaggaaaatgttctaattaaaagaagcgagagattgcatagtaaacacaatgttggtttgatattttaaaactcagatataaaaaattttggggggtttgttgaataaacttgaacatagattataatgaagtattgtgtctaccttaattttctcaagtgtgatgttgttatgattattgaaagagaatagtctttttctcagaaaataatgctgtggaatttagggatgaaatgtgatactctgcaacttctttcaaagcagttaaaagtaagaaatttaaattgtatttttgtcttcatttattgcatttatagatctcttaatttccttgtcaagattcaagattctatctagcatcaccttttttctgcctgaagaaatttttaaaatatatttcaagttcagctctgctgacaatgtaatctctgaatttttgtttacctaagaaaacctttatttctccataatttttgaaagatactttcactgggtatagaactgtgggcagacagatttttttctttcagcactttaaagacatcactatgttttcttcttacatgcatgatttctgaagggaaatattctttactttttttatttttcggtatatatgtataaattttttttctttattggtaagattttctgtatgtcttgatacttctatttgaatatgacttctgtcttgactggtgttcactgagtttcttaaactccccctgccctttccattttttttttttttttctttgagacagagtctcactctgtcacctaggctggagtacagtggtgcaatctccgctcactgcaacctctgcctcccggattcaagcaattctcctgcctcagcctccctaatagctgggattacaggcaccaaccaccacgcctgattaatttttgtatttttagtagaggcagggtttcaccatgttggccaggctggtcttgaactcctaacctcaaatgatccacccacctcagcctcccaaagtgctgggattacaggcatgagccaccacgcccggcctcccctgcacttttcttactttattcttccaggattccaattacactcagctcttagatgctctgttctgctttattcactctttctctctttgtgttttagtttaggaattccttaatgacatcttcaagtctaccaaatctttcctttgatatgtcaagtctactgataagatgaaggtttcttcatcactgctactatgttttccattcctagatttctacttgatttttaccatctatctattgaaattagcctgctgatgatgcatattgtctgtgttttccagtagagcttcaatatatgaattagagttatttcaaattctctatgtgatagttccaatacctatgtcatatctgattctggttctgttgattgctttgtctcttggtagtttccttccccccactgttttctcatatgcttaataactttttgctgaagctcgacattttgtccaaaagagtggagactaaatagtttctaaacctaagaataggcatgtttttacttctgataggtcgttagtgtggaagtttgagcaatgtagtcagtagttgtgctgggtttgggtttgttatgcttgcactctaccactggcttccacttcctttggttatacttgtgtttagagtgaggactggtttgccagagagtagtctgtttcactcccatctttagggtaatctcttcacactgcaactctctgttagtccatttgcattgcattcctatgtaaaaggaaatcctgaggctgtgcaatttataaagaaaagaagcctattttggctcgtggttctgcaggctgtacaagaagcacggtgccaacatcttctggtgagagtctcaggacacttccactcataggggaaggcaaaatgggagcaggagcatcacatggcaaaagagggagcaagaatgacagggggaaggtatcaggctcgttttaaacaaccaaatcttgcataaactcattgagtgagaacttactcattaccacaaggacagcacaagccattcatgagggatctgccctcaggacccaaactattcccactaggcccacttccaacactaaaggttatatttcagcatgagatttggagatgacaaaacatccaaactatatcaatctcggagtctctacccacacacttttgtaactctcaaagctcttaatcactgttagatgtcactggaggcttttcagcccgggagcgtggtggtaagaggagcattgctgttctaattaagccttggttttaggcgaattatgtccttaggtttcagaaaggtggctgcctccgtgttccagtgtttcccacagctgtaattctgggaagggagtagagttttatttttaatgcttcttatctctagctgcaatggctgttccctagttccctaagacacttcctcctgcagtttaaagcttttctcccaaggagaattaggggagggtgggatacaagcaggacttcttgtctttcctgcagtggctgctgttctcctccccatgttttgtacaatgaggattctaccacagtcatttttttgtgtgtgcatgagcttctggtggggcccaaggaaagagcctattctgggtgcaaatttccctgttatcttgccccaaggttttctacagtgagaatctacaagccagttaaaatttgttttatgcctgcagccaactgaaccacattccttctttactaatttgttaccaggtgagcaaatgctagcttaccctctctccccataggcacatatctttttttaggttttaagttagttggtattcctgcaatcacagctctctgactagttcaagaaaagttatgaatttgcaatttgtccaattcttttttaatgctgagagtgggcataatacttttttattccagctttgttcatcccaagcaaaagttggaggtctctgaaacttaatttcaaatagttcagcaaaaaaaatgaaaagaaagagaaagagtaaatgaaagagaaggagaaagagagagagagacagtgagagaaagatacataaagaaagagcacaaatgtggcaacatatcaagaattaatgaatcaagatgaagtggggatgggtattcataatactttccatttctgtgttgacacacaggcagtgctcaattaattaccttgaatgtaattaagacataatttgctgaatgacagtattattcttgttattagttcccaccaaaatagatgaatcaatttttttccctttctagtttgacattgttaccctaagatactaatcctgctgactctatttttaaaatccaggtttactaaatattttatctacttatctgtcagcaatgtttcaactagaatagaaatgcttttgcataaattcatcactcattgagggatcagctaattggaaagagcattagatatggaattttgaaaaacaggcttaaatgcaagcttattcatttcaccaatatttatggagatcttacagtgttctattgattgtatgagaggtttgggagtgaatagtagctctgctgcctctcagtcccttgcacctgcacacatttatatggtttgagccttggtctccacctctgtgaagtatggataacaacgcctccctcatttgtgagagttaaaatccctgttatatgataaagtgctttgtgaatcataaacaaatgatccaaaagcatattattctaattctcttttagtttcttcctcacttgttcttattttttttacttttttttctttgcatttttgtaatgtccttggccttggtttcttactttattttattatgactgcttacactgttgtagtcatttacaacttcatgttaatcaaaattgtgaatttcggcaaaggcaacagtccctgcctagtgtatgaccttttttcccctttgatcttggcatctgaaagctttttatacattctaattctcttccattttaatagctctgtgaagcagtactattttctttgactgataagatcattgaaggtgacctgattttctctagagatgcacaatgaataaaacacattctccactacacaactcacttactcacatcccatgaagggggaaaaatcctgaggttgctctctctctataaaggtcacagaaaaaggagatgacttctcagatattgtgattatgcatgtatcatcaaattatgcaagctgcttattattccaaatcttaggggtttttttgttatttcatcctgttttacataaaactgagtagcaaaagtggcaaaacaaatatagcatttgtctttgtttgtgtatttttaatgagccgaataacacaaacaccttaattttgagggtgcatcttgttgagacacaatattatagatacctgtttgtacttgtgtgtatgtgtgtctccaggtattacatttatgcagttttcagttggaaaggtgacctctttctacggagtatgtgccctgcacatagggtttatcccttgtgactggtttgtgtgttaaggattcatggcttaaacagctaggttattcatgggtgtggaaaattgatatttgagagcattttattctgctcagtcaggctgattctttataaggaatcaaaacagtgataacatttaccaaaaactactgaatagaatattcaatgtgtatctatgccacacattgtttctttccatacactccatcataaaatacctcctctgcctatcatcgctctgacaacgtcactgccaaacccctatcctcatacactcatcacagaacatctcttcattttgttcagaaactgtgcttttttttcttaatcgttctgcttttcaaagctttattctttctaggcattcaatatatattgaataatttcaaggtatttttatattcattcattctactaatattttcttaactattttcagctactcttctaaacatcttgttcaggaattgtggaagaatctactcactgttttgtcccaatatccaagggagaaaaataaaactagctcaacatccctgtgcatgaacttttagtaactttatttccccactagaactggaatctgatgatgagcatctttgttctccagatttcaaggaggtactccaggtagctgactttccacagagccctagaaagtaaatcatggaggtgaggatactgttctctgaaattaatatagaactatagttacttggtagtttatcttgagcaagtcttgttaattctactgtaattcaaaatggtagtatcatcctaggaaaggatgacaaacatgtagttatagtgagtattctcttggtttaaatcacagcattaatcggcattctgtattaagaaaaaggcaatcatttgcccacattctccttttccttagttttttttttttaatttttagcttcagaaatgtaactcatatacaaagtacgcctatagttataccatgtatcacacatttcatatgagtaaaagaacagaaaattgatgaaacatgcctgaatgcttgtgatataaaattatatttcagttccagctataaaagtgtaatacaattgaaatgtttatcatgcatctatgaatattttttcttgcatgcataatggtgttgcatgaacaatttaatttcttttttgaaaaaagtcatcctagagaggtctattctataccttttcgacagattcatctaaagaccagctctataaatgtccagattgaatgcataaaatgtattgtctcaagtgattattgtttaaaaaaatttaactgtattgttaacttactgaaaagcactggcataattccgcaggcatggcctcttttcttcttatcttcatgtgtgtgctaatgttgtgatctttttaaaatgccaagatgaactgtccggtatacgaagataaaagattttaaaggcaacgcataatgccactgaattcctattgaaatttacagttttcaaagaaatagtattcattctaacatcaaaattattgtcagaaaaatataaacatagtaaaataaaaggcacctgtgaatccgaagctatcatggttcaaactcttctatgaaaacacaatggcactcaaagacttactatggcttaatatctattattaatcaattagtatttttcattgtatgaaaaatttataactaaaattttaaatttaaaaagaaatggattgattagaggccaggtaatcaggctcttggccatgaccatatttttttttttcagtattagttaagtaccaaagtatttcacaaagtccagtattcaattgattgcacaatacacaactagatttcatatttttgtaatccttggcattacttattttctgcacattctggacacattcctacatttttatttaaatggcttttacatcttataaaaagagtactttttggattcaaatcccttattccatttctggcaaccttccaagagaactctagtctgaatcattgcattgattttctgttgctgtataataatattaccacaatcatagtggcttcaaaaaaaaacacatttattatgtcaccttttctgtgagtcagtagtctgggcacagctcatctgagtttttgcttcaagttctcatccgaaagctacaaccaaggggtcactcatgactgggttgtcatgcgatgactcgactagggaagggcctgctttcaaactcatttggttgttggtagaactcagttactgattgttggattgagggcctccattcctagctggctagcggctgaaggccattttcagttccttgcaattagggcctttcctacacagatgcttgcttcattacagtgtgcaatttgagtaggtagtagagatactctctcacaagatggaaggtataatcttatgtacctggtcatggaagtgatatctgtcccattttctgtgttttattggttagaaataaggcacaggttccacctacactcaaaaacaagggatgtaacagggatatgaatgccacgaggctggatcactgggggtcatcctaggatcttcccagcacactttttttgttttacatttggtagtttggtaatttttccaaatgaatactataaaagtgtaatagaagaagtagtatatgtcattgaatgtagttctaacccagaaattacagtgaaggtaacgctcatatgataggatgggcagtttcattattatttgtcttgcctgttaccaagcattctaatgatgtttcattgagaagactgttctttgagattagtatgtatcataaaaatgcctctctttaactaaattgtggatatttgtctatgaagttcaggtatttgttttcataataggctgtatttgaaggacacaaaaatttatataaaaatactaaacaaactgaagcccaaatttgttactagttctagtgcaccaccatgacatattgattacactgaaatacaataatgactctcaatatggacatctgaaaattaataataactatttgattgtcctaggaaatgatctggatagctaaatatagtctgactgaaacttacgtagcccaggcattaagtacatatttgaatgggcaaatcttatgaaataatgcattatttactagaacattttccctactggtattttctactagaagtccaaattagggaatcatatgaggatataaaattaattcaaatatataaaaatattttggctgtgtttacagcattaggaacaagctgtactcattctagcattacgttaatgtacacttggtaggcattagaggaataaacagttctaactacaagaaacagtaaaaaataagatatatatactcataagtcttctcattctgttaagagcagttagtaaagaattatttctaaaatttgtgaaataattattgctcataaaatttttagctaataagaaacttcagatggttcagaaggtaatagaatatgtcctatttggttcaggaaacttaaaattccttctccttaaaagtgttggattaaggcgtttcataatttttgaaaaattttgtatttattggcagtggtttttacacttagagattcttatttcttccacagtgaaattgtttatttaaaaaagatgtttctaaaatatgtgaagagaaaaaatagtgcaaaatattcactttgataccaagaagagctttgattatacagatactctaaaaaggtattaagaacctccaggggttccatttccacagtttgataaccactgcattagcacaaatccttggaagtatgaaacactttgtctgtgtttggtataaaggccactgaatgtgctaatctatgtgaccttggcatgtagtcagcatctgttaatagatttcaggatataaatgagatagtgcatgtaatgtacttacaacaattaatgacacaataaatattatgtgttagaaaagctacatgtagcatagtaattgagagtacggactgaagactgcattggttcaaatccttgctgtgcccctctgtaagcttgaataaattatttaatccctgtacctcacttttcccctttgtaacattgagttattagtaataacaacttgtgagtattatataaatgaaaaacacagtgcgttgatcacattaaacactatgtaatttaaaagatcattgtaaattatttagttcctagagacagatgtattcttaatacattttaggcctttgttactttcagtcatttaacaaatatcaattaattcacctactacatccaaaacaattcaccaaacagtatgaagaatacaaaagggaatataaatgtgatttttgtgatggaagtgtttattgtttaatatagaatataatatattcacatataagtagcatatggaagaaaacgaaagacagcacaagaaattaaattctcagagaagagaaaaaaagtaacttctatgtatttatgaaagtcattttaagaagtattcagaaggttgttagaattgagtcacagagatggctgatgttaccaagggttacttatcattggaaaagagattcataggtacatgtttaaatatggaaatctttcatatcttcagacgttatcgtcagctcaaacccgattttcacagatggcttcacacactgcaactactctctcataattacttatgagagaaaatgacctgtttccctttggccattttgagaaactttcaggaaaaaaaaaaatctttaatttagaataacttaaatattgggccttacagattgactggcaaagtcaaatccaaatgcaagttatttcactactctgcatcccacttaggtgtttttctttcgtgaattatttcctgggagttagggctctttcatcttttatttgcaaagtgaaaagcaaaattgactcatcttaacttctaatttagctttctgaatcggaaagacaacctgaaagtggctgtggggaggagcgctgcttggtctagctggctggagaccttttacagtgtggatggagcccctttctcaatggttaagtggctgccacactcagtagcctttctgaagtcgcttggtcccattctttttatttttttctttttttaataaaggggttaaaagaaaaaaaaaaagaggtaagataaactgcccttgacagtatgattcctttcccttccctctgcccaaatacagatagaaaggaagtctttccatctatataaaggcctatttcatgttaccaaagaggaaaagagaagttgagaaatgcagccaattaggagaaatgagagcaaaacaggtagtacctccgtgtgtcctagcaaatggcccaacacgaggatttttacctattttatccacatagaatggcttgcgaaaagcctttgttgttgttgtttttacaattcatagacttcccactgataaattccaatggtcgattttccccttaaagtgaaaaccttcctttgggaggcaagcaactcaaaaaaaactgcctgatgcgtaatgaagtatgttttttgtaacccacaccagttctatccatacatactttttttttttctttctgacaccttcacctcctgccttacgttcctttgagctatggaagccaatgaggatgaaataattaaagtttgtgcctgctgtacaaaaatcattctccataggctctgtttttatttgatcttttgtagaaaacatagcgtctttatgtacacagttataggcccatggtgtcaggctacaaaggcttcatttcctgctatccagagtcctggtgttattctccaagcataaattctgtagtttccctcctctagcccagcaggtgtctgggtttcatttttggttgttacagttttcatagggaggctggggtggtctgaagtgtcacagcagggatccagcattgcccctacccaaaatttgctacataatttgtgaggccaagggaaaaatgcaaacgcaggacctcttgttcataaatcattaagtgggtgtttttaaacacagtgtgctgtgaagccacacaggtcagatgcccaagaagctggctctgcccctactgtgccagtgcctcctgggcacatggatggcagggaccctgtgtgttgcccttctgtgaaacaagaagtctgtatggttggttgggcaccgtatggttggttgggcagtctgttctttcctgtgcacttcctgtacctcctatggtggtccacacctcgaaagccccacactgcaccaccttccttggaggacaactctattaaattctgcacacccgctacccctgccaaatcttactcttttttttctatttaaatgccatttattcacaccccctgcaaatacatacatgcaaaatccttcataatgacccaatgatgcaagcaaatagtcaagcaatgcttaatagcaattgaaaaaccatatccccacctcaagggtagagaggactgaagtctttatgaactcaatggctagtctgcatccccagaactggaggggaatgcttgcatttcttcatttaagacttctcccctcctcctttccagaatgaactgaaagaattcttacaaggcaccacctcttataaccctgtcccccaaaaggagatttttatattcaaaaacattgtacattcatgtattaaggcttttagaattagcaaggactttaactctttggaatttgcagaagttgataatgcaattatattttttaaaagtttacattgtaattgctttagaaaaaaaattagtgatactgcatatacggaattagccaagcctgtgtacacttgctgtttctgtggtctccatggactggaatttggttaaaaaggcaagtttatcaattgaggtttttaaaaatgcctgctctttcaacaaacccaacaataaataatgaaaaataattaacactgtaatatcaaaagtgaatattgccaaggacaaagataaatgatagccaaaaatacagtgaaaaatctcaatttaaatataggaaaagagaacttggcttctagagaacagcaggtttcctcccaagcctatgctgagtaatatgatatgaaattgttaccactgcttttctattagaaatcttccaattcagttttctttattgacccaattccctggtgtttagggctaggctgcttttttctgtacacatgtgtgattgcttatccgtctagcctaggcttgagttattttatttgattggtaacacagacctggcagaagcttcacctttggcatgcagatgtccacaggtgatgtgaaaagagattgaaaaaggcatttgctgataaaaacaaaacaaaacaaaacaaaacaaaaaaaacaagctcagcatgatttgattgccatctagctacaaagtgtagctagaattgatacagtaggccagaaattataattatatccgccttacaatttcagaacagccatgtgacccaagtttataattgttggtgccataagagacaaaatagctgagtaaaccactcctacaatgtttttgaatataaaaatctccttttgggggaaagggttataagaggtggtgccttgtaagaagtctttcagttcattctggaaaggaggaggggagaagtcttaaatgaagaaatgcatttatacaaaacattatacattgtacattcatgtattaaggcttttagaattagcaaggactttaactctttggaatttgcagaagttgataacgcaattatattttttaaaagtttgtccaattccttcctgaatcctttaaagtgcttaccacattcacttgtacatcctgaatagacttagtatttgtttaataaagggatatatgaaataattttggactgttagagccagaactttagattatatataccttgactggtattacattgcctccttcatgtcgactccatttcattatctgtggatgcttgcatttagtactaactgcaatgagaagcctttgaggccacatctgaacccaatgggaaagaatcctgtgattgaatagtaatgtctgccaaacccaaggaagagaaaaaaatgccaccatctctactataaagtgactctcctccaccagaatgtgttccatcccctctttttacaggcaaacaaattggggatcagagtggcaaagcattctattgcatatcacaaaattagtagcaaaatgatgatatgaatttaggttctcagactctggttgtattagtcagctcagtctgccataacaaaataccacagactggctgtcttaaagaacagacatttacttctcacagtcctggcagctggaagtttgagaccagggtgccaacgcagtgaatctggtaagggctctcattgatttgcagacggcagccttctcactgcatcctcacatggcctttcctgtgtgtttgcacaggagaaagggagagagaaagagaggggagtgggagaaaggtctctgatgtctctttttataagcgcactatcccattcatgaggaattcaccctcatgacctcatctaaacctagttactcctaaagtccccacctccaaataccgtcacatcgggggttaggaattcaacaaatacattttaagagcacataaccattcggtctataacgttagtcacatgcactttatatgtcacaatgtctcttctcctattaggctgactctagttctctttttactgaaaccgccttgctttttgtatcatcgttttaggcttggagaattctaaacagcctctaggaaatatacatggttgagttgtttgacaggttatgaacacattgtgatcaaatgcagtgactgtttataaaatgggtgccttgcagaggagagtttaagcaaagtttaagaattgggaaaatccttaatcacatctctacagaaagaaaaaaagctgtaagagaaagcagaatggtacaggaaatactcctcagagaacagcggtgagggagggataatatgaactacctataaaatatgctcttgaccaaccatatatcaccttcagcctgttctttttgacgcgtgactcactatctagggatccccttctgttggctcacttggcagcctctgagattagttttcccaaagcaatttattacccaggtggtgggtacatgttacataagtccaaaagtcatttctcaccacttttcttgtcttccttttattattcttttaaaatatatgctacttctacttcattattttcaaccatctcagagcatgttgaaagtattgacatgtactttcagcatgaggaaaggaagttactgcagataacataagaagaaatatgtgtttagtctctgtccctggttctaatactgagctcctaaaactcttacaatttccttagtgatgagtgctatgagcatcttttgtcctagtatttgttttttgtccctggttcctgacacagaactctggagctcctgattccagagcttggaatttcctggatcataggagtgtcatttgttctaatgatgtgactcatggtgggctcctggatagcttcagaatgggagctggccactggaaagcccaagctgttagtagaagcttggaactttcagtcccgtctcccatcctccaggaaggggagattaggttaataattaataatgtctatgtgatgaagcctcaacaccagtccctagcctatgaggtttggaaagtttctgggttacaaatgcatccatgtgccaggtgggtggtgcaccccaactccacagggacagaatctcctgcacataggacccttctggatctctccctaggtaccttttcagccagctgtttattcgtatctttgtaaaaacctgtaaatgtgactaaggttacagcaaattatctcatcctagagggaactgttgaaactcctaatttgtagccaagttgagcagaagtgtggacaccctgggtacccaatacttgcaactggcacctgaaatggagggtgttcttgtgggattgaactcctaacctgtgggggctacacttactctaggtagtttagtgtcagaattgaattaaattgtaggacacatccaattggcatttgcagagaactggagaattacttgctgtaaaagaaaaccccatacatgtaatgtcaaaagtgttgtgagtagaataacagctttcttttactctaaattataattttttgaaaaatcactgttacagttcacattctgatcacaataataggtaagcagagcctcattttgacacctacctactttattgcggtgccgtgctctagtatttagtctgtatctcaaataactcttcaatctgcctcgtccttttgatccttttaggtcagtccttcattatctcctgttagaagtctcctaattttctaatggataagctcatctagtggataacaatgggataatattcaaaattcttacatggccagaaagccttcattgattcttttctgtagggtaccaccaattctcacttttctgaagtgcttatctttcccaaggcactaggattttaatttctctacatcttttttacttgctagtgcctcttcctagaatttcttcccttaccgtgtatttctagcaagctactactaatctttcaaaacttaaaattaatatcttctggccaggaagctatttcctgtctagcattctggttgcaggaaactggagcccacatggaccatactatacattatttgcagcatttgtaggcaaaggtgcctcatttgctgcaaatgtataatggaccctgtgctcattgagctccatcttcagtctacagagtccagaactgctttcagaagttctgttcttctggaggtaaataaatggaacctaagtccaaaattatttatacattgtcacagatgcacacctgctgctaggcctcacatgtgcaccccaacaacaaagatagcaatgacaaccacacacacacacacacccctgttgtgctcatatatgtataaatacactcattgtacagaaagccttaaaactgcccttgaatatgaaaataagatatttctcttttatttttgtcctcccttatccagcttagaattagtctaccttcaatgcatccattattgcttcctcaacttagctcacccacacagcaattaaactccacgtatttgaacaactcaaaaattccatgtgtgcaagaggctaagtgcataagaatcctagggcctagatgacaagaattactaaagaaacgtagcccactccttctcactcttttgcagttttgtatgttatatgtacattagtatgttacatgtacattaatttgcctgaagttgctgtgttggcttaatggaacaccattgccacctgctagccatattgagctattaaagtcctgcaattaaccaaattaagcgcaggttaacacaatcaggttttgctgtgctattgttttaaataacttttacgtatttaaatttagagtgcacagtgtgacacagcttgccatttaatgactcagcatgcatacagtaacctcagctaaccagcattaagtggaagtattatgtcttggcactgaagaatatagactgacatcaaaaataagagtttcaaggctcagttccaccatttgttagttatatgatctttgataagtcacttaacctgtctagactcacattatttaaaaaggtaaaaatagaataatagtagtgccttcttcatagggttgatataaccattaatgaaataagaaatttgaaatgcttacgtgataactaccatatggtcacaatcaatggatgttcctgcatattatttctctagcgttattacacctttcttctgattgccaaatatgtaaattcaactgtttctctgggcctccattttctcatgaactctatggtttaatttataaatatgttccaatgtagtttcatttgttttataaaatacagtccactacaggtagtgctccatttgttcaaccttatttgtatatgatgcagtccactctgtgaacatcagatttcaatcatcattgccttcccactgcactcacttttataaagtcaaagcataatttatagtaaataaaatacagtgatcttaagtgttcagatcaatacgttttaagaattgtatataccatgaaactgccatccaaaacaagatatgaaacgttttcttgtatgtaggaaatgcctcatggcttttatctatgttttttttccccaaagcatgtgttatccttatgcaggccctatgctaatctctgcatcatgtccattttagttcacgcaaccaaagtagacatgacacattgcaattctgatcacctctctttttctcacaaatccagtagaaattataaagaagaaaaagcaacaattaatccagaaatgctatttagtcaattgaagatcaacacattctaggtgagcgctgccccaagaatgtttaaagggagaaatcttttaaaataaaatgcaactataacattattgatatttttaaagggagacaacaggatatctcttagagaaatggaagtacctgtacagggcatcatgttctcagactcctcacttcagaatctgattcttagctctgtggacttgggagactgggttttcttagcattctcagagtggatcagatctttatggagaaaaacttgcaaagaaaatttagaaaacatttacatataaatcagaaaaatgatatatttacttacattaatatattaatatgctaataatgtattattgtaatctgctgttttcttttttcatttaccatatacttacatctcttatctaggattccctgttctcaacctttagttcattatcaccctcctctcctcacaaaggagacttttgagaccactgccaatgaaattttgatactgcatttgtattgtttatctgtatatatctgtttatgtatttctgtgccttatacatggaaagtaacattttctttcatttctcccaataccccagagccaattttcacctccttgggggtgatgtcaactccattgagaacatgtatcttattccttttttcctgctacctggcagcatgagatgttatattaatcctgtctttttattttctgtacttttgatgctttgacatctagggacttgctgactctggaaagactgccctttccaaagttaggcaattcttagagattaaaaaaaaagactccccttccagcatccttttcatatgcctttaataggcaaatcaaacaatctactacccacatcccaaccatctcctttactgatcctttacactccacgccaggttcagcttgtcctaattattccggggccaggttccagacaactaaagacagcctctgcaccccagaatctgaagagatgatccaactagccatttctaagccttcttacattgtattcttttccatggaaacctctatacaggctcttgcctatgtttttctccactttctctgcctctaaactgagcctggtgattcctctgaaaccctgcatggtgggtcctgccccctcctcttgggacctgtgaataataaaccatcttttcaatggtaatcttctcctgatttcttgggttcatgatacctgaatagtaataaaacctaaatttaaaaatacctatgtatcagggagttggttggccagtatggaatatgaataatcttgagagatatttgttagagttttgatgaagacttgtaaattccccctgttccttagaaagagtgctgtgaaaacactaccaaactcttgttctttttacttttacttttcttttctgggtctatacagacatctttatagttaattgactttttagtaaagagtaactgattaaactcatagcctttgtttaggctccacctgattctgccttcttagtttaccttttgaatgaaactgagtgtctccaaacattttcaggcatatatttatagtcaactcttgtggctattttgacaggtggttgacctcattcattatgtattgaatcttactattctcacctttagtataatcttatttctacatttttgggacacatcactgaaaccttctgtgttccatacgagacctgtaccagatatctctgcagccaaagagaagttttttttttatttttattttttcatgagctaacacaaggcttgcacaaaactcagcagcaagtaattcctttcttgtccagtatgaaaaagtgctgtctttgtcataaagcaaaaagagacaatgaaaggttaggttcttattgccccatctcattattgttaatgcaaaactagactaatttgcttgtggttatggaaatacctcctttaaccttggtgactgaatcagaaagaatttgttttggagatgggcattgcttaacagcatttggcatttgctcaggctgagcattcatcgtgagagtaagagccttctttccttctttagtgtagtaatctctgcagaaatatcacatgaaatatggtgcagaaaaccttcagcatagtggctgggatagaggcagtgtgctttgagtaaggctcttcagttggggcctgcattttctctggagccaagatacttctgacctcagcaaatggcttaactgctctgataaaaagtggatgataatgataacacttccttcttttcagatccataagaagaagagatttttttgtttttgtttttgtttttgtttcatctcctgctgtatgcttggtctctaaaagtgactggcagagggaagacaataaatatttgttgttgaatgaatgaagtgttatgatgagggttaactgacattataatgcaaagctcttggaccaagacctgacttatcataggccctcgaaagatattccttccaaaaacaatgacagcaaaaacaaaataaatgcttcatactcaataaagtgtctggtgatgggtttataggaaatttagtaattttaatattaaaaactaccatttacatcatctgattatttattcgccaaatatgtatcaagcaatcactaaataccatgcattattgcaggtcttggagatttagaggtaaacaaaaatagccacaagtaaaagctgtccacctataaaactttctgcccagcctagcgcaggttagagttcccatatgtctatcagtgatcaatagctgtgggagaagaaacctgtagaacactgaaaaaaataaagcattcagatcattaacttttttattaatcttttgccatttgtggatctgtcagcttctctaaaactcttgagatacaaaagcattatctctgagacaagagataattcccaagctctcctcttgattgcccacgtttgcctgagagaatttctcaaccagttgtttcaggttatagacataattggctattagtcattgcagtgccattgttcattgacatacctctcagcatcatctctcacccatctgcaaagcaaggtcctggtttctgattaatctttggctggtcattgaggatactgaagcagctcctggttaattagaccattttgtctctaacctcatccattctctggatgtaataatagggatagaggtggcagcaattgtaagcacagccctgaaaacttgctaatcggcctttgtgatttgccaggggtgccattgtttaaattgttaaagccaaattgttgtgagaggcagtaagtgggcatttttatctccaagtcaattacacacatttagtgaaacctaaggagctcataaattaaaagtaaataagtaaataggaaagcagcatctacaacacttagtgatgtaagtcacacacatacacaccacatacagggtgataaaatagcaaaatgtgcacttatgtggagaggaagcccacgtagtgataaggggtgagggctcctgagtttaccagctgtgtgaacttgggcaagtaaccgctctctgaaccttcttatctgttaaatggaagtaatattaaagcctacagggacatcaaaaggattaaattacattaatattttatgttatttcattaaataagattttataaactatctcaaagtctgctctattacgtgtgctaattatctggtagttactattattctagaaaagcatcctatcccccctaactcatgcaaagaaacaatgaacgtttccaatacttcacattaaaaaaattactttgacagtatccacaggaaatcaggtaaaaagcaaagacagacaagcttagctctttccactggactttgtgagatgtgtctagttgtactagagttcaggcgagcattctaagagatgctggagggcagaaaatgaagtgaacttcattctatgaagcacttgagacttgtctttcccagtatttccccatcatctctcaaagaactgcctattaataaaaaacaaacaaaaaaaacttattccttggtatgctaccaaaaaaaatattcttcattcaagtaagtttggaaaccactgagtattacatttccctgtgaagaatcataatcattattttggtgttaaaaggcctgagaaatcaggaaaagctctaataaaaggaataaaaagaatagctttgaatcctttaacctaatttttcaaaaataccccacacaacatgtgttaccacacaaattgcattttgaaaaaatgctggccaggcacagtggctcatgcctgtaatctcagggctttgggtggccaaggcaggtggatcacctgaggttagggattcgagaccaacctgaccaacatggtgaaacccgatctctactaaaaatacaaaattagccagtcatgggggtgcatgcttgtaatccctgctattcaggaggctgaggcaggagaattgcttgagcccgggagatggagtttgcagtgagccaaggttgcaacattgcactccagcctgggcaacaagaacgaaactgtctcaaacaaaaaaaaaaaagaaagaaagaaaagaaaaaatgctgagctacaacatagtaggttgaagagtgtcctccaaagcatccgcacccactcagaaactaagagtgcgatcttatttagaaacagagtcttcgcatatgtaatttgttaaaaatcttgtaatttgttaaaacctggattttgactgggccttaaattcagtggctgatgtctctatgagaaaagaataggacacacagattcagagaagatggtgacgtgaagatggagacagagattgaaatcatgcatctacaagtcaaacaatgccaaggattgctggcaaccaccaaaagaaaccagaacgtcatgggatggtttttccttcagagcctccagaaggaaccaaccctgctgacacctcggtttcaggctgtagacttctagactcctgaaccatgagagacaatatatgcttttttttttttttttttcctgagacaaggtctccctctgtcactcagtctggagagcagtgacaccatcacagctctctgctgcctcagccacctcaggtccaggtgattctctcacctcagcctccctagtagctgggactacaggtgtatgccaccatgcccagctaatttttgtaatttttatagagacagggtctcaccatgttgccaaagctggtctcaaactcctaggctcaagcagtccccccaccttggccccccaaagtgctggaattacaggtgtgagccaccacacccagccaaatttgttgttttaagccacctagtttgccaaaattggttgcagcagcactaggaaactaattcatatttagtatttttaaatggctatttgaaatgtaaaaaaaaatgccatgaaatatattgcaattaaaaactttgttctctctgctgcctatttgttttggttccattttttggcaatttgaggtagaggaattggaacacagacgggaggagataagaagcactctctgctaagtgagtgattaagagctcactcatggctcaaaaggaaactctccattatattttctattatcacttgtgttcttgtcaatataagtacttgccacttgtgaatcattttggcgtttgcaaaaactttcttaaacagtcaatttcttccattctaccaccaaaagaaacaaataaaataaacaatagacaaatgcaatagcaatgtttactaaaattaagtttttcactctgcttagctttgaaatctgtatggaaaattaagataaaggcctacattttcatagataaagcggtagaaaactttgtttttagacatatatatatgtcttttttttagacatatatatatattttttaagatgaagtctcgctctgttgctgaggctgtcactgcaatgttcacctcctgggtttaagtgactctcctgcttcagtctcatgagtaggtgggattacaagtgtgtgccaccacgcctggctaatttttgtaccgttagtagagatggggtttcaccatgttgaccagactggtctcgaactccttgcctcaagatatctgccctcctcagcttcccaaactgccaggactacaggcgtaagccaccgtgcctggctcagcatgtatttttaattcagctctttggagagctgcatctactgagcactgcgtgggcttagtctcactgtgtagttgaatcttggtggatggaggccatctgtggtacctctaaagctacagtaagaacagccaatgccatggcatcaaaggaagccagaggcatttggaccttttggggtctggcaggcaaataaagaaaagactagatttggcctgagtctagtttcttctcatctggacactagctcatagctcataactgggctctcttttttaagctccataaatgcaagcatgacatgcatatgtgtatacagaatttggacatgttttccaaattgtaaatgtgatcacagccttaagtaaaatttatgtctcccaaagccctcaggattagttcctcattctttaaggaggctcaaaataacttcatgtcactttggttatctctctagccccatttcttgtcaactttttccttaagaagaataacttgacttctctaaatactcctttatttctctcagggcatatgcatttacttaccctatactctttcttctttctttccctttgtttctttcgttctttttttctttttttttttttcccaaggtctgattttatcgcccaggctggagtactgtgacacaatctaggctcactgcaacctctgcctcctgggctcaagccatcctcccacctcagcctcctgagtagagtagctgggactacaggcaccactgtgcccagctaacattttgtgtgtgtgtgtgtgtgtgtgtgtgtgtgtgtgtgtgtgtgtgtgtattttttgtagagacagggtttcactatgctgcccaggctggtctcaaactcctgagttcaagtgaaccactcaccttggcctcccaaagtgctgggattacaggagtaagccgccatgctcagcccctattctctttctaaaagaatccatttgctctttttttccctatgattgggttagcatcatggcttccaatgtttgactgaatggttttaaattctaccctccatgaaacgggaaaattagcttttttttctcatggagttttgttgagatttgaatcagataataaatgccaagttactacatataacagagagttgtcaaaaatatcatcactctcatttttcatatcccagcttaactatcattggaactgaaaaacactccctgaacctcacaagattcgattagataaaattagctgtaactattagaacaaccccaacatcaattcccttatatccagtagttccacttctagaaaagtttgctaagaaagtaattctaaatttaggaaaaacttttattattgcattatttataatagaaaacaaaaatatggagctacccaaacattttcacttcatttagacttatcagtcttgtgatggattgttagggaccttctgaatcatattattccattaaaaataaaaattcacaaggacaaattaatagcatagaaattcctatgttatattgttaaccgaataacagcagggattaaaaattgatgggatagtatagaaaaaaaaatcctggaattacaggtgcaaatatcttaacagaattattttgtaatgtaataattgggtattttttctctatttttctgagtcttgcaaatattccataataagcatccattacatttataacggcataaaataataaccttaatctttaaaaaatgctagtggagtaaatgaaacttttcctgcattttcttgccagttcatgtcgctggggagtgtcacttatttctcttgtctgtttccctatggtgaaaaacatagaaacatgttgataaagaacacaaagaaagaatgcatgactaggaatgaggagaaggaaaagcttcatgcatactcagctgtaacatgtttgggccgggcgcggtggctcacgcctgtaatcccagcacttcggaaggccgaggcgggcggatcacgagctcaggatatcaagaccatcctggctaacacggtgaaaccgcgtctctactaaaaatacaagaaatcagccgggcgtggtggcgggcgcctgtagtcccagctactcgggaggctgaggcgggagaatggcgggaaccccggggggcggagcttgcagtgagccaagatggcgccaccgccctccagcctgggcgacagagccagactccgtctcaaaaaataaataaataaataaataaataaataaataaataaataaatacaaataaaataaaataaaatttttacaaagtcaatgtaacaactcagggaaactatttgtcttcaaacattgaagtaagaaagacaggaacccaaattcagaaccagctgaaccttgaaggaataaacagtaaatgtcaagggcttttctcacacagggaatgaaccggttttcctgctcataaaagaaaacaaaaatattgagtatgagtctgaaaaatatgaacttcctcatgtttgtcatctccataaactatccctgtcattttatctttttactgagaggaagataatttagcaaaatgaagcacgggctgctatttcattttcttattacatatttgaattcagtctagtataattatggtgtttatgaagtttaaactgatgtagcaagagagtaataggaagaataagtgatcatccactctcaacatgataaggagcatttcttgataagaaagttgactttaccaagtacaggaaatatgtaagaggttttatcagacaataattttaatttatgagatgctttcattgtgttccactaagaaaatatacatttatttctaaataagttagttttaaagcaaagtgagaacaacagtagcaaaaatgtctcacagttacagacacaggcaaaacaaaaacaaaaatacctgcccccatctgtgagaaaagagctcacaaagaaccaggaaattataaatgagcagatttgcccttggctgtaggcaagatccctgagacagtaataagaaatgaggttaccaaacatccagagagatatgagctgataaaacttaatcaggctagtttcacaaagggcaaatcttttctgacgaatttggtggcatttttgcatggcacatggggcaggagaagtacgtgacaggaatgcgggatagaattcaactgaagaaggtagaaagccatggatgatacacatgaaaatgaggtacggtcttagctttccgaagaagagcacttgggagacgtttagcccaaatgcgttgatttcatgaagatatttatgttgacaataaacatgaagcgtggttgatggactggcatgcttagcagtgaaaccacggtagcaaaattatgtctgttatcatcaaataatgcacgcttggggtgcgtatgtatgtttgccattccagattttttttagagtattctcatcagttatttgcagtcatgcactgcataataacattttggtcaatgaccgactcccccctatgagatggtggtaacttaggattataataccttttctatgtatagatatgtttcgatacacaaatactccccattgtgttacagttgtctgcagtactcagtacagtaacatgctggctgtgcaggtttgtagcctagaagcaataggctgtgtaccatacagcctaggtgtgtagcaggctatactgtctaggtttgtgtaagtgcactctgtgatattcccacaatgacaaaattgcctaatgacacatttcgcagaatgcatttccatggttaagccactcatgactgtatttactttttccaaatgtttatgttattagtatatatagagagagccaatgacatttcagagagacacactcttatctcaaagaggaaccaatgggccacactgcaatatctcaatgataataataggttttacagcatttctagcatctttactctgagacatttttaaaaaacgcttttagttgttttgtgtacttgacagtaggctgttatttttcaaaggttaatgttgaagtgttctaaaattgggaaagtaatagggtcaaatacccagaagttcaaaagaaagaatctgagtttcctgcttagttggtccctcagcgtcaatgtacaaataggcttgtctctttcatcttaaaaagataaataatccaaactgaaatacatacatacaaacaatttctctacctcctgctgttgtttctgctcacctctcccttctctttgctgtctgacttctttatagagcaacctgtacaccattccatagttttatttcagttcccagtttatctcaagcttggcctttatgtctcaattcatcttgatttgagagtgaaatttctcccaaagaagaaacaaggactttctgatgatcaacattagtgccttattgctgttgctcttgtttttcacggttactctctaacatatataactcttaacatgtgtaactaatataactcttaattacatcctccttgttaaaaactctcctgttttggcctcccatatgatggatggggtaggcagaataatggcccccaagatgtcaatattctaatccctggaacatgtgaatctgttagattacaagacaaagggaaattacggttaaaaatggaattgaggttgctaataaagagattattttggattagctggggaggcctttgaagtagaagagggaggtagaaaaagggccagaggaaaatgtaactatggaggaatagtagagtaatttaatgtgagaaggactcaacatgctgttcctgattttaaagatagagaaaggtgtccacaatccgaggaacgtgggcagtctctagaagtcgtataaggcaaggaaacagatttcactccagagcctctaggaaatgcagccctgatgacatcttgatttgagctcactgagacccattttggaattcaaacctacagaactataagatagtaaaattgtgttgttttacaccattgagtttgaggtaatttgttacggcaacaatagaaaaatagtacaatggtgttctggcaaaatagtctcaacttctcatgcagatcttcctcagaacattgggctgttttctttcttttgtcaattccctagatgttgacagtccttggttttcatccttagctttctttttattcagttccatgctgttgctgccttttacaaagcaatgccatcaaactcagtctctttccccaaccagattcctgcttgtagctacctatctacatctacaagtccctcacaaaatccaaatttaacatgctttatgatagtttttaaaaaggcaaaatcatcaatttcaaagaaatgtaaatgaacacatgaaagattttctttaactcactgatcaatgaagggaccagtaaaatgttgcaacttgttcaaagaagaatccaaagtaccacacatgtgtaggtgataaggaatgctaaaataaatgtataaatagatgcagaacaggcttaccatgggtaaattggatggtatgtgaattatattttaagaaagctgttacaaaagcaaacaagcaaaaagtttggcttattcattagggaaaaataggaaaaaaatcacctgcatttcattggacacagtttatttgcatttcaatgaccaaaagtcatttgcattcttaatagttttctcctctttacattgttgcaaagtagttaagagtcattgaaaggcagggttaatcttataatctgcaatctgcaagagtacctaattgcagggtactctgcaatctttccatgtccatattgaaattttcgcaagttttcctgatatgtcctatcacatatctctaatccaaatactttctcattctcctgaagatcatttcacacatacatccctcttaaacctcccatacttcccctcctatcatctgtctcagctgatgatcttcctacttcccaaggaaataagagaaaaaaacagaagataattttaacttgctttccaccccacatgcatcagtgtattttccatctgtctccacttactctgccttccctcctgttactgtggatggaagctttctttctaaggccaaccactgcactgtgaactcagtgcctccctgtcaccaccagggtgtcactcaaggtattgtcttctccctctcctgtatcatcatgttcttatgcaactgcatcatgcccagaatcatgtcaatataatgtagtatcccatctcaaccaaatgcaccattgaccccatgtctttctgtagtacaaacctatttctctagacccttttatgagaaactccttagaattttttctttttcaaattcactgtcttcaattcctctctttacatactccatatcctcactccattcaggatgtacactccactcagcaactcttgctaggtccttagtaacctcttccacattgctaaatgcagtggaatgttttttactcatcttatttgcctagcttccctatttgtcaaagctgaccattcagcttctttaattttagattctagtccatcactctcataggacactcctacaacattggctattgttcctcagtccctttactggttcctcctcaccagtgtgatctttagttgttgctgtgtcttcaggatgggtttggggtctttgtttgtttgttttgctttgtatacactcaatccgatgatcttcaaatgcatataccttcagttcataattatctccagaactccagattcatctattggatgccaccttagatatttcagtagaaagtctaacagaaacctcaaactcaacatttataaaaccaaagtctttgtcctcctcccaacccccagcacaagccagctgttctacttgagtgttttctctccccagaaaatggaaaacctatccctccatttccttaggctgaatacctgatactcattcatgatttccaaatttttctccaacatattacaaatctcattgctttaatatacaaaaaaagatctagaatccaattattatacatctataccacaaatactttggtcccagccaccattattttcccttaaattatatcaatgctttcagtctcaggggtttgacgcttgctgttcctctgcctagaaatttttctcagtgcatgttttattatccacttttcttttgatctctgttcagatgtcaccagaccagtgatgccttccttcactgccttttataaaataacacctgacttcagcatttctagctcccttaccctttatttctctccatagcactcacaacaatctcatataacttctgtttgtttgttcatttatcttatgcctccctcaattagaatacaaacgctgtcacagactcaaagttatctgttttgttcattgctgtattttcaggctctaagatggttctcgcacatagtaatcccacaaataaatgattgttcagtaaatgaataaaaaataaattaaatttatatctcctctctcatcttctttcattctcactgctcctcatctttctcttctcctcttcctttaacagctaaggacttcaacatacatgcattcttccattcatccctaatagctaactcagagtaatctctaatgctgtctttgcctctttcctcacatcaaatcatttataatattttgttggtattgtgcctacatactccaaaaaagctctcacatcattcttgtcctctttattcctactgacaatgcccaattatctcagtggtttcaaacgtttgataaataatctccttgatctgtggtttctctttccctatccttcctcccgtgagtcatggatctaaacatatcataatcttgcttaaaactgaaaacacttccatgttttctaactgtttacaggtcaaattcaaacctctgtcatatcatttaaggtccttcaaaactgttctaaatctgccattccatctttttatttcatgactctcctaccttccagactagttatattcttttgaatgacaggtattttcatatctttattcaagcttttcttcttcttaaaacttccttactgtaactcctgtttcaatgccattcttattttcattcttttacacatagttcaaatgttgcctcttttggcattcttccaaaacctctaggtagaattaattgcttccttctctgggctcctttaaaattatatttatacttttggtgtagtacttatcctgtaatattgtagttcgttaattgttttcttattggcttccctttctggagtataaatcatagtgatttacggtatgagttctggagtcagtttgcctagactcaaaattgagcctcaccaccctttagctatttgatattgaacaagttatttccattctctaaacctcattttctcatctttaaaatggaaatattaaaatctgcctcgcagagttcttgaaaggaccaaataagataattcatattacaagtttaacttgattcctggcacttactatgctcccaaattattatttgagtgtcagcttcttgaatgtaatccacttatttatttttgcattgtcagtgcataaagaaggttcaacacagagttagagctaataaaagttggtcgagtttacttatgttggatttatcactgtgtgctggcaatatctagataagcaatgatgtagaattttattttggtctggctttaacctaaagagatcaacagaatgtgaaatatatgctaatgaactcttcttattataatttactttatgatctgcatgccacttccaatatggcatatacattttaggcaggtttaatgcttaatctcaaatcacaaggtcaccatagatgtctgactggactgaaatacttcatatttcatatttgaatactggatcttcaactttataccatgtgtataccattagttcattctgctagagtaacataaagataaccagaatgattccattatgtgaaaagcagctttcacattaagaattgtcttctcaaatgtctactgcatgtaagaaataacaagcatggccactgtcaggtgactgtgcagcttctcttcttcacatctttggtgttacctagagtaagaggccactgagtgtccagtccttagacacagtctagctttgcatcttgtgaagtgagtgctgatttcaagtatggcttgaatctaactgatgcttgatgttcaagcgttattgaacatatacttttgaaataattccaaatacatttgttgaaagtattattatcaaatgattattacaatgaaaatttatttttattacaatttaaaagacaacaattcaaaaatcagtctcccatcccagcccttaaatactgagcaacatcagtgtctccagttgttggttggacaggtaaaactgtgagccccagcaccatcaaaatcagtatctttatacctgaattagtattttttcctaatacaagcattcctcttttctttattcctctattttgaaaaacaacaaatatctgagcaatctttaatgtttccttttcctttaatcatgctcccacattcagttaactggcaaatcaccttttacctttgctttcaattcttgctcccaccaccttagtaagatgtatctctctacttagactagtataagaatttcataactatttttaaaactctagctttatcatctttatttttgaacatagctgacaaagtttacttttttccttttttctttctcctatgaagtaagtctgacatatcttcactgcataaaacccttcaaaagataaacatcaacaggcagtgggatctcagttcagagcttgatcttttgacttaaagctccggtctgcctctagttcttaagtaggacacttgacctctctagaattacttttctgttttattttttttctgtaaattaggtaaacatttctctaagtattttttctattttaaaattttgtgacttgacaggaagtttaaagaaaattggtaaaagataaatacgtgtggtaaggggagggagaaggaagaaagaagggaagtgaagggaagggaaggaaagggaaggaaaaaggaaagaaaaaaaaaaggcttaactctttatagaacctgcattccaagaaagatattaagtgagtttagtctagcttaagctctacaggttaaagagtatgagtttgaaaaactaaggtagaagcttggtaatagaagaaaaataaagccagggagggtagagcttttatagtactgaaagtatgcagaactcaagtggatgtataatttgtgtcactctggacttggagtcaaacctggatttgaatgccagctctggactattaatagggatgtgattttgagctaattatttaatgtctttaagttttagtcaggttcaactacatcatttgcagaccccagtacaaaaggaacatgtgagccccttgttcaaaaggcagaaaaaaattgccattaaaggcattaaaatataaaatgttttcttacttccctggtatctttcttgatctggaatgatgttttttatttgctttttaatggcactttccttttgggcatgggaatactttctcagcgaccctcacatgacctgggggccttgccccaccattcagtgtaaatgtgactcactgctgacccactgacttccaggttctccctttcatcagctgcctaaccaatatgcagtgccccagctcatagccccaactcacactaatggaaaatcctcaaaggctttgcaacatttgtgcaaattagacttctgcggtagaagatattctggaggttccaggagccacggtggggaaatatattgggagcaacaaaattctaacacagaaagatctcaggtactttatatctgggtgtgatcttggagctctctagtcttatccctgggtgaaacctgaaatttacccaggctcatacaatgtgattcaggtagaaccaaaaataatatgacttttagttctgtgttcttttagatacaggctttctaatgtatgtgagtttcccttgtgatttcctctaaaagcccaggttgtctgcacttttgtagttctggagaggaaaagcagccaaacactggtctctttctatggtttatttaaagctatctttctcaaggctgttttagttgtaagaaacagaaaccatacaattagtggttcatgtaacctagaggcagatctcactagaaattgaaaccaaagatctaaaaattcagggaataaagcctctctcctctaaattactcattctctccatcattctgttcccccccaccctctctctctatcatctacttatctcaatttctgcctttgtgtagactggtgttctctacctcctcatgagttttatggacgatggatattataaaagttatgaacatcctcatctctgctcaagcaaccagcagagactagcatctcttaatattatatctaaattcttgggagagagaaacaccagagcccaagaagaacatattcacttctcatccagtcagccatggcccaaggaatggcctaaagcagattgaacatgcctttaaggatctccacagtttaagagctacttctccatgaaatggttcatgggccattcagaaatgccagaatgtcactgcattcgaataaaaagttctcagtatttagggaataataatgaacgttagataccagtaggttagatgtaatattgcagtcagatcatggaattaactttttaattccatagaagataatggaggaagaaaggtagggcagaaccctttatgcattttcaacaatattgtacaattttcatataattattacttagaaacatttatttttcagtgtctacctattccaaagttcttgccttactgccaaataaaacttgttttttttttttttttttgagataaggtcttgaacttctgggctcaagcaatctgcccgtcttggcctcccaaagtgtggggattacaggtgtgagccaccatgcccagcctctctaataaaacattttgtagagagtaccattataatcattggtgattacaatgtatagtagtatgtatacacatatagtttttatatgtgtgtgtatatatatacacatacatgtgtgtgtatatatatacatgtgtgtatatatatacatatgtgtgtgtatatatatacacacacacatatatatgtgtatacacatacacatacagtagtatgtgtcttcaatacaattactcactgattgtagcagtggctcaaaaataccaacaccattctttttcccaaatacattcttaaagcacaagtatttgaaaatgcattttgatttcttgtttttgatatcatattgtcacatgttttcagctgttcctatacagaaaaccaacattgttcttgctttctgattgtatagacaaaacaataaagacttgctgttatttcatcatttcattacagtatgagaaaaatctaacaatttaccaaaagatattaaacaattagttgaaactagactttttacttatcaagtggtataaattcaagctcctaaaaagttgataacaaatataaatgaaaaaaaggaatgatatcaactgactgatgataattcaacaagacctaacttctgtgtctttcaaaatgacctaaagttacttagaaaaatgtctttaagtttctcatctatcaaatgggaacagaaatgtgcatctcacaaaaggcatcacagggatttaatttggaaactgctgtatgtatatattttttgaaaaccactaatcattctcacaagtataagatattattaagccaagttatacccccaatttggactacatgaagtttaaaccagacttttctctgagtgaaagtaaaggaaagcaaatgaattagcatttgttgtgtgcttgttttgtgcctggcataatgtatgttgcttaatatgcattatttcaaccaggttttctttttttgtgtaggaggtagggggttggaaactttaaagagattttatggagatctgcaaaaaagtcattcatattcccaccatcaaaaattaagttaccatctcagcgtatttatttcccatctcttttcttcattttttaaaaaatctgatgtttctttaatataacgcatttttattttaatcattcaaactatgaaatattatgcaaagaaaataaaaaacctatctccaataaaactttctctaaaaataaaaattattaatattgggtaaaattatagccatctttctatatatataaatacagaaaagatatactgtattcatgtatagatagataatagcatagaagaatacaaatattttataaaaatgagatcataccatagacgttacttttaacgtcaagattaaattttattttagaaaacagaataaaacaaagtaaaaatgataaataatttgaacttctaataaatgatttgagacaaaaaaattttttaaatgatttctctaaggttaaaagatacaatgaatgatacaaagaggtcagagtgcctttgtttgtaaatacaataatattatatgtatatatgtgtacatgtatgtatctatagactttttgctgtgaaagatgatactagcgctcatactagctaattatattccctcattcacttctcatttttctattttgttgtttatcttatcgaggttgtagcatttatattctgttctataactaaaactagcagagttcttaagtgtaagtttgtgtttgaaagtattctgtgtgtatcccattattcctctttcattctcaagatctgcatattgattcatatttaattgaatggatttcattgttaagtgatctctttaagaataatcatctgttatttttcatattagcttttttatattagtttttttaatgttcaaattgttcaaatgtgtttgttggatgtcttttttttttttttttttttttttgagacggagttttgctcttgttgcccaggctggagtgcaatggcgtaatctcagctcactgcaacctctgcctcctgagttcaagcgattctcctgcctcagcctccctagtagctgggattacaggcgcccaccaccacgcccagctaattttttatatttttagtagagatggggtttcactatgttggccaggctggtctcaaactcctaacctcaggcgatccacccacctccacctcccaaagtgctgggattacatgtgtgagccactgtgcccggctcagatgccattatatttgaaagatatattggtgataatactaaagtcatccttccatttggaatatttacagacttttcttcattgacttctggtataaaatggtactgtttaaaatcccagcttattctgagttttcttttttactctgtgtatgtatgtgtgtgtgatggggtcttgctctatcacccaggctatagtacagcagtgtgatcatagttcactgcagcctcaaatccctgggctcaagtgattctctcacttcgtctcccaagtagctgggactacaagcacccaccactgctaatttttcttttctttttgtttttggtagagacagggtctccctatagtacccaggctcggtctcaaactcttagcctcaagtgatccttctgtcttgatctctcaaagtgcagggattacaggcatgagcccctgtgcccatcctttcacttttacttagcttgctatttctgtccagtcttcttaaagaagcttcctcttgatgttcttcaaatattagtcacttaatcagcaaacgctttggtgttgagtattcactctttcaaatatttctggaacatgttctttccatttatagtaacttttcttaatggtatttactgagacatgtgtttgattctataactcggtgacatcaaggatcttaatgttgaatcatctttatctatgtttctaatccattaccttctcctcattgttttattatctgtgcttttttcacattatgtgagataattacaatcatctcaaaacattatagcagtaatgtgactttcagtgggtatctgttttgttgcttgcctattccaattgatttatttgttatttattgatgttgcctgggttacagtttgcatccttaggttcatggtctccaaatttatctggttctattgtctgtgtatttttttcatattgacattgttatattatttttaaaaactcatgctcttattctatagcataaaactgttttgaggaattccccaggttttcttgagttatgttttcttttagattgagtattttccctgtcttggtcatgccatgttttactcttttattgctgcaatatatttgcatagttactattccatttcttttcatattgttcatgcttgagaaactgtgtacagaaaattcattttacttaatggggaaatatattttttgaattttatttttattatatctgggaacaattttttttctccttcttagctccagtttggagacaggatttatggcgagtacccacattttgtagcctgagagaatgatggggccaaggaaagttcagcctttttaggatacctgggtgcttctctctatcctaagatttctttttcaatgaattgtagccagattattattggaagagacttcagtatacttcattggaagatgtagcacttttctaatgggcttcagaggcttcacccctgagtgcatgggcatgacattattaattggttaaacagagtcagctttactatccatatttccccactttacttttttttttttcctagaagcccttttcattgctcttcagccagaaagaggtaaaagaaaaagataagacctttccatctgtgtacatacaaatctgcttatctccagatttagaagttataatgagaattctcagaatgctgttatttcaccagtaaatcctatagggtgtgaggacgacattaggaaatcaagaactccttcccttctctgagcctgaccagactgcttttactccacagttgtttttggtttttttctttaagtaattttgtcaggatatgttccttttcttttcaggcattgttaatttctgtttgtctgttatttgtacttacaacgtctcacacatttcattaggcactgatactgatataagaaaactcactcaaacatcttcaatccacttgctcgatcatcatttacaggaacactaaaatatatgacatagcatcctcctttaacagctgagaaatcagagaacaagagtggtgaagtaaattgtccagcactggggagccagtaattgaccaggctagaattaaaacctctatctatctacacttctaggtcactgaggaaaggtgcctaaattacaattttaagatgaggttaataaaagaacttattttacccaattgcaaatattttagaagactaatatgatggaagcagatctgagtggatggtgaaaacaatggagagggaatcaggaagccaaagtttaatttcttgctctctcttaagacagatgttaaatttggaaaagatgattcaacttcctgggtttcaatttccttctctttaataataatgatggatgatgatgatgatgctgatgattgtcataatttgatgactatatatctactcattgtgaggcacaatgtgacatattttataaacaatatattattaaatctcaaaacaaccatctgatatacacattgcatctattttaataacaaggacacagaagattgcttaaatcccctgaggcccatttgattccagagcacacgttcttaaccagtagctctatggtctttccaaccaagaagtctgacctgagtggtctgtaaaagatcttccagctttgaggttctctagtgctgtggttggtatagaaggaaatgactatgggttaacataggagaagcaagctcacacatcactcaagtacaattattagagttacagactggacttcaaattaagtcctaacatgatcaggtttacgcttgatgttgtgcattgcactggaggggagaaaacataatttcttttatttccctttttaggtttttagttgagacaccctcctacaaacaaaaatcaaattaacaaaagaaaagcagaaatgtattaacacatgctggacccatcatgccgagagacatcaattcaaaagtatttttctcaaggcagtggcttggggtgatgtttcaataatattttatcaaaatgccataaattctgcatagtaacaaggcaaaggaaagaacagttttagtcctttaaaaggtgagaaaatgtgagaggatagtgaaatctgttctcagattcctctggtgcctgctggtgccttctctgggctgataacaagtgctgtctccagtaaggaagcatggatgtcctgccatcaagcaaacagaggctgaggccgggtattctcctgccttttcagtgcctttaactcaacaatcctcaatatttggggaagaaatattttggtttctttcaagacattaaaaaataaaaaccacagaatttcaccttacacatgagtactaagctcttcctcatcctcttccccttccctttctttcatagcaatttagtccaaatgccatgaattggagctgagtgaggtaggcatccatgtgcatgtggaagaggagagccacagcagtccagcctgaggtgctggaacctgagagaggcgagagaggcatccatgcagggcaggggttaggacagtggtgacttggtgtgagtggcagagcccaagtaaggtgagaaggccatacctgtggtggggtggcctggcagagggtatcagagcctgaggaaggggaagagggttccattgttaggggagggtgttgaaggcagaagcctggagtctggtgttggagccaaggagaaggagggtggtttctgggggaaagagagctcccgtgtgatctgaaagatgtgagaaagcgagaaagctatccatgtaggaatatgtctgtgtaccaagtgtcagagcccgagtggggtgaaggaggacatccacactggaggcagaccctaaacagggtcagaatctgagtgaggtgaggagggaggaatcacccagctagtggtgtcagggcaggtataggagtaaaactgggagtggacatcaggacctgagcagggggaagaggacgctgacagtgatacgagactagtcacatacaggggaagtgagcaaatgcataaatatgtcaaagataatgggcaccagggttctcacagcctaaatgggagttgcaaatataaacagaggacaactgtaaatcaccataaatgaacacatcacacacgtataaaatctacgcacacacacaaatttgctgagaggctctgggcaagagcacctcaaaaaaaaatgagtacggtgagcatcctcatgatggcttctaaataccaatctctaataaaggaagccaggttgttttgttttgttttgtttttgtttttaacaacaacaacaaaaatggctactttgctggcagagcaggtgaaatacaagatgatcctggaactctctcttgtatcagaaaggaagaattcaaagaagggtaaggacatgccaaaggcaagccatttgaaagcatcgaataaatagcaaatgtattataactcatttaccaaaataagaaaccttggattcacaccgataaaacagatcatcctcatagaaatatatgaataaaaagtttaaatgtccagtgaggcatatttgcattgtctaaaatccctagccacaaaacactaattataaagaaaaaaaagatacttacttttatactggagaagtctgacaggtaccaccttagtcaaatgattatttaacttcaagagcaatgggacagatagaagtcttaaccttctacctgacagaacgcagcataaagagcacagcatcctgaatcgaattgtaatgaaagtggtttattacctccaatggtgtatccagtgaaggaggagaggatagagggaaagagggcaagacaatgggatcagtgtacttgctggctgggagaagccttttttatagtgatttttaaagccaatttttactgcttttattattatttttgaacatctttatagacccttttattatatgtgcccttggcatatagctcctaccaatacagggaagagtctgtgacttgccattgatacctgactattcagacaagcccaaatgaggtgaaactttaccacataactgccttgtgatctaaggtgttaaagtcagggaaatcaaggaaagactgtggaattgttgcagattgaaatagactaaagagacataattaagagaggccatgcatggtggatcatgcctgtaatcccagcacattgggaggctgaggtgaatggaatgcttgagcccagaattttaagacaagcctggcaacatggtgaaacaccatctctacaagaaaacaaaaattaacctggcatggtggcaaaaattaacccaggagggctaggtgggaggttcacctgagcccaggaggttgaggctgcagtgagctgtgattgtgccactgcaattcagcctgtgcaacagaatgacaatctgtctcaaaaaataaaaagaaaataaaaaagaaaaaaaatatcaactggattcttttggtgtaaaagattttattgggggccagacacagtggcttaatcctgtaatcccagcactttgggaggctgaggtgggagaatggcttgaggtcaggagtttgagaccagcttgagcaacagaaggtgactccatatagccaggcatggtggcaggcacctgtagttctaactacttgggaggctgagatgggaggatcacttgagcccaggagttagaggcttctgtgagctatgatcacactactgcactccagcttgggtgacagagtgagacactgtctctacaacaaaaatgaaacaacaaaaaatagaattttattagaaaaaatgggaaatgggacctgaagattagctgcttagagctgaatcaatgttaatttcttgatattgttggttttgggggtgttatgccctttgtttgttggaaatataaactaatttatttgggtaataggggattggtttacaagagaaaaaaattctttgtccatttttgtaatactttttgtgaatttgagattgttttaaaataaaataattttaaatatgtatattgaattgatatttaatatagacttgcattcaaaacagggccacttttttttcatgtgatttattcttttcttttcccaggtgatggtcttttaagccgtcctatttttactcaggagccacatgatgtcatttttcctttggatttatcaaaatctgaggtcatcctgaattgtgctgctaatggttacccttcgcctcattataggtaaaatcctacctgtgggcaccacactattttgttcttcctcactgaaccaaaacatacacaaaataaagtgttttataaaatgtcctaatttgtagtgtacagctcaaggaatttctctacgggtatgcagccatgtgacaatcactcagataaagatataggcatttccagtaccccagggtattccctcatgccgctttccaggcaataattaaccccctacccaccagctccaggtaaccgtacttatgtctctgtcttattgattaggtctgcttagaacatttattcttgagattggtgccatgcattgccttattgtggtcagaaatgagagagagagagaagagagataggggagagagagaagagaaagacaggaagcaagtaacacaggaagccaggaagaaaagaaagataaaaggaaagaaaaaaatgaagagaaaggaaaaaaaaagatttgtttcctcaatttgaaagactaaaatgtaagctcattttgcatttcccacccctgcctcaatgcggaactgcagcctcagttgctgcatatgcaatgattatgaaaatgttctataaggaatgaatccagatggatatctagatttatttcatcagataaaattatgtgacttcactggtgggtcacatcacccaaaaatactgattttagaaaaatatgttgaagacagctatgtaccctctaaggcagaaagggaatttttattctgggcaaataagaaaaaaaaacctatatttgtttctcacatattatttgtggaattctagggagaaagggtcagtaagtttttgttcttatttatcaagttgtagcaaaggcagaatttgcttcatattgtgggtggaatttacaaatttaaaaatatatgcatacgtaaatattcataggtaaatactacagatatttagttagtagaaacttcatatgtagtgttaatacaggaaaagaaaatacatattaaacttttgtagctttgggttttaaaacctttttttaagtcttgttttacagatgtgaagttgatatgacacacacaaagagtaacaacttcagtgtattttggcaaaataagctggtttagcctgattttattttgcagtaaaaatacactcttgatgtgcatagttatttagatcctaaaattgtctagattaatgagttaaatgacttaaatgcacttaattagctaaatgacttcaaagctaaaggcaattctaccttatcttgaatttttttgagctaacttcagtgtcttctttttacaacaaaggagctgaaaaaccatgtcttctcattccacagactaaagcttccttgtctttatcatacccaaaccagtgaaactcatctgtcaggggaagatccttcactttgcaaatttgggacactcaattcagagtttgttgatttgttagtttttcttaaatgatgagctgtcctattagtttaatatatggttaaatatatgaaaatttgattaatacatttagtgagatcacctaatacttaaagtagtaattttatgtttgagagctaactaggttgatcctaggggttagtagagaaagaatataagaattcctataacattttttgaaagtttgctgaatataagacagacacataaatacataaattacatatttatataaaaaatctattggcttttaacagttagaaggatataaaataggttctcaagataatttgctaattagttttatctgtgaaaaaatagaatgaaggcaacagttttcaatgttgttaaatggcttttatttctaagatccttgtaagctaaaaggctaaagacaagtaatttatgtgcttatttccagcccccataacctggtttggctcatttcttttttttttaacttttaagttcaggggtacatatgcaggtttgttatatagataaacttgtgacatgggggtttgttgtacaaattatttcatcatccaggcactaaccctggtgcttattagttatttttcctgatcctctctctcctcccatcctccatcctccagcaggccccagtcgttgttccccttactcatagacaagaaactatggaaagagagtgagaaaagaattaagtttttaatgcttaaatgtcagactcaggcccaactttattgataataaagcaaaggacagaggtatttcagataacgtgcattaccaacaaaatgtaaaagttcagttttaatatgaccctttctaacttaaattttattttttaaaaagcctcacaactatattcaccttagatggtgtgtgtgtgcatgtgtgtcttagaaggaaagccttcacaattcacagattctaacgttatttgaggttacctgggtatagtgtaaagcaacataaaagaatccttgacttaaagttatcatttctagtcacagctctatcaatccattggtgactttggaataatcatttttctctcctggcgtcatcttccttattcataaaatgaggctgggtttgattttaagatgtgttttctttcttttagtaaattccatacagcaaatgaaatctcagggaaaataagcaatattaaaagcaaactttttgaaagagcttaagcttgcccatgaaaaaggattaccctttattctttcaaagatcacataacacatgagaatatgaagtccagccctgaagccctgcaaagggaagagaaatgggctacccaaagatggtgctttggaaggattgcttatacctggaaagtctaggaaaatcatgtagcaatgaacttagttctacctcagaatatatatttgatttggaaaaatgaaataacatacacataaattatttctaaatagaatatactctctatcagaaaaaaggatttctgacaatcttctctctacctggtcaccagaggagactcctttctgtaatttagtctactctaccctagtcatgaacacaaccttaagtctagagaagctctaggcctctaagaaaaaactataatagtagtgactctgcccttctgttctttttattcatttcccgcaactttatccttttaacaatcctgtgagataagcagaatatacattattgcacacatcgtataatttgtgaaatgacttctggagaaatcagaaggcttgttcaagtatatgcagcaaaggaacgtcaaagctaggactaggattctttccacaggggtcacagactcaaattcagtgtacatcacaatcacccagagagacttaaaatttagattttggtgttctctgtcagaggtctggggatgggctcagaaataagccaggcagagagagacaaatatcatctgatctcactcatatatggaatctaaaaaaagttgatttcatagaatcaactcatagaagtagagtgtagaatggaggttaccagaggctgagtcagggaggggcaggaagggaaaggggacaggtgggtcaaagggtgagaagtgacctttagacaggaggaataagttctgggattcatttggacagtagagggattatactcaatgataatgtattgtatatttcaaaggagctggaagagaagattttgaatgctctcaccacagacaaatgatagatttttgaggtaatgaatatgctcattactctgatttgatcattacaaaatgcatacatgtatgaaaacatcacattactccctataaatatgtgcaatcattatttgtcaattaaaaataaataaaactcaaaaaaaaagaaacacattctttcagcaaatataccatgtaattctaaagcacagcctaattttgaaaaacaccaacaggcacaagcgcgcacacatgcacacacacacacaaacacacacatattacggaaggacagccaacaaacacagcccacaaccattattctttttttgtttttgtttttgagacagtcttgctctgtcagccaggttggagttcagtgatgcaattttgactcactgcaacctctgtctcccagactcaagcaattctcctgcctcagcctcccgagtagctgggattacaggcgtgtgccactatgcccggctaatttttgtatttttttaatagagactgggtttcaccatgctggccaggctggtcttgaactcccgacctcaggtaatcagcctgcctcggccttccaaagtgctgggattacaggcgtgaaccaccgcacctagcccagccattattcttgacacaggactgaactacttaaaagtgaaggatgtttcccaacaaagggtcgagattttagttcacatccattatgttttctggaactaatatgatattaattcagatgctaaaagcaatcatttaaaacacatttcctaggttgcatcataggaagacacttgtcagtatgcaattctatcagaaatgtgtgcatgacaatcatttgaattcattaatactgtttctccattgatttagacatattaattaggacaaagcccacaccaggagttgaacccctgatctatatgtacagtttaataatcattgtaccgtagtgatcagaatgattatggggatactgtgaaaaattcatttgctgccgctaagccaacaactttgaatttgtgttgaaaaacaattactgagcttaattaggagcatgtaatgatgacagcggttatttcagtgattgattccaaaattaaaaggagctggcaaactaaatatggtatatcctatgctttgaaaacgatagggaacatggaagtctaaagagcaaattatcaaaaactatattagagtgctggcaaggagaatattggtgtcttgagacaggcctaaagaaagaaaagttttgaagggttttattattgttttttttttttttcacttttttcttaccctaatattgaaaacgagcagtctctacaaattcctctagaaaaaaatgatcgcagaaaatctaggcaaatgaaatgtactctttaactgctgtctttcaacttccaggtgtgcaggaaatggctaaataatttcaaagttaacagagttggttcaaaacctttgattgatttgacatctgatccatcacatctcatctttaacatggtagaggattacctaaattcatatttcttttctactttggtaggcatttgtcagattctccccatgggatgtttgaagacgcgcccgaagaagtcaatgacatttgaattaattctgtatttttagtagaggcggggttttgccatgttgcccaggctcgtctcaaactcctggcctcaagctatctgcccaccacggcctcccaaagtgctgggattacaggcatgagtttctgcacccaacctctttgaattaattatgtaaaatgtcattttttaaaaaattaaccactcccaccaaaatatttttaatatgattttggtataaaggggagaatcatagcaaagctggcataaaccctaaaaaacacagtttggaaactggctatattccataggaaaagatcattcacttgttttcctagatgactgtgatggggttcaggacataccacctcaaaatatggcaccttggcatttgagaaaatagcagaagcaggaagatcattctcaccttcccctcactcttcttctctgaagcaggtcataaaacctttattccagaggtatcatttctatatccagaggaaagaaacacccttttcctcctcaaagacacagagaaatcaagaagaattggaacaaaaggccttgctaacttcccgccagtttcttaccattagatcataccctctttttacaatcatacttctgcaggactgtctactcttcatcaaaactagcattaaaaacacacaggttttcctgttttttaggattttttttctgaaggctttcatgtcatggaatatttatattaaataaaattatatgtttttctgttattaatcttcctttccttttagagacctcagccatgaacttagcaatgagtgagaaaagatatttttctacatgcacaactgtttgtcattattcaatagttttaagtgtttattttaaaaaatggtctatgtgactatacacagcctgtgccctaggaatgtatctcattagatatatacgattcatgcttcaaaatatttggggattttgatggagttgggagtttcaaggtaggaaaagtgagtctggttagagataataatcaggtattcatttgtcttaaaaatgaccaaataaaatttctaaaactagttatgaatctttgaaagtaaatataactctaagactcttcagctagttaattcatgtactaaagaattgttgactaatagctaagccaagagaatttttgcttctcaaaataaaaacctctcaaacagcatttgctttgctaaagtataattttagtttggcatttctaagtaccattgaaatattttcaacatgattaattttccaagtaacatactaacagaggtaatcatgttctaaagtagtcaggttattattgttttgttatcagccctgaattggcgttgtaaaattatgcttgccgctttcaatatacgcttcttgaattcctatctttaaatcattttgacattcaattttgtgctaccagttgtggatgttcaggtaaggtatatgttatttgaaaagtcactaaaggaataggttggccagtattattgactgactgtctaatttttatttctcatgttgagagttctgtttcctctttgtatacatttgggtgaatgtaacttataaagagtacatctttcaaataatctagttactgatctcaccaaacccaccaagacagctacctttggtaaaactggtaggattacctccacatgtaatcatgttttttggtgttttttatagttgcaggaattagaactacatgttttttaagacaaagattgattgactctgtatattataagcactttattttttttttccttgaaggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatgtgagtttggggtaaattttgtaatctttgtctctgaaaatataatattcttctgatacacacattttaaaaatctagctttgccaatgatatatttgagaatgaatatgactttatgggcttttgacaatgttcattttgtgaatctagattcttgggtataatagaaacctgcttctaaaaaaagaataaaaaaaacagggaaaagatcaatgttattatattttgtgaattatttttagaaacatttctaaaagtttcagacataaatattaagataaagatgtatgatatagcattctttttctttttcttttgcattggatattaatgcaatgtggagagcacaggaagaaaaagctgagggcagagaggtcatctgggggaggtgggcgttctcccaagaaaagcgatcatgcacccgtagtttgatgtaggtggaaataaagtggttgccaaaggcaggctttatattaactgtaacaatgtccagctgcatcacataaatgtcatccaagtaattaccctggtgacatttggggacattagcagatgaacaatagacatactgcgtctaatatcctttatatatagtgtttccagggactgaaatgtttcatactggattcagcaaaagccttgcttgagagtaattatatctgttgatgtggataaagtagaaggcttgcatttctccctttgcaccaaccattatgtcccagaggatctagccaaggaaccaaaaagtgagctgctatacctgcagggctcatagaaatgtctatactgtctgttactttgaaaaagtaattgttctgaaattttattaacaaatacatgaccaaaactcaccttgtgaaactacttcagtcatcagtagatacatgaattaataactgggtctgtttctcattgcaagtcttgtgttccaaagattattctacaccagagatcccttgatctacacagagttctctttatgttgaccattttggggatggccttgcttctgattttacatacaccacatacacatacacacatgcacacacatatacatatatacagatatacacacataaatatgttgctaactgtatccaaatgtatttgtatctatggaagtaagaagtgaacgtggaagtttattaacctaaatagaaggtgggaaagggccagtggctactttcgaacataggataaaaatatttataacacttgatttcttcatttcagctaagactatcacctggaaaaataatagggaacaaaataacataaaaacttatgttatagaaataaagaattgttccagactttgaacgattctgccacagtaattgtttatttctcctgcttggataggagatgaccctacaacatacacatgatatgaatcagattccataatcataaatttgactctttggtaaaggaaactccatacagcatatttatttgctataccctcgagtttctctacagttatgattctatctactctcgaaaacagttgaatgtctacatctcaaatcaatgcactctttgatataaccatagatttcttctcctttgttctgtactttttaacaaaaatatgttttaaaatgtcctacattattatatcataccttctttctgctttaaaaatttcttgcaacgagaagtttctctagttaaaacttattttgtttatgccatatcagaataaaagtctcaattaagaagaaattatatgctttcatctggctaaatgggacaaatcaatttttctgtccttattgactttcccatcttatcataaaattttccattttggggcagaaggtgtatgactgttgatcttgaaaagcatttctattacctttaatgcagaaagtaagatggcctatatccattaactaatctttcttctgcaaagttaaaggatcttaggctctaagagcttgcaaaagcaaggaccacaacatggtggtggtgtcatgtctgaaatatttctcattgtatccggggagacatgtgcgagagtgtggaaacagagagtaaagggtataaatgccagtccccaaccaaatggaaagttcctaaagtgcatgaactgtaccttcatcttaattataattcctcacaacctccttcataaatttttaacaatatcaattgtgatagaaaaggcctttggtaggataaccacagcagataaatgctgagattttgggaaacagagaggtgtgagttcaaattctttttgtcaaatatctagtggtatgaaattaggtcttttcttaacaacgttaagcttctgttaagaaatctatacgatgaggatacagcagtagccaccacataggacagtgacatggagtcactgagaaaatgaaggtcaagtccctgatccattatggaccctagggaaatgacagctctaattctttctttcactattattacctatctcaacttagacagacatctatatatttcaaaccacttgagtttcttatggaaactctcctagtttagtttacatttgaaaacttcctaaaggctagtttcttgttcttttcttttcatgtcaaatataatacatgtgctttgacatatattatttcacttgaattggacaacagctgtaggaggcagttgctatcattgcccccattttacagattagaagcctgaggctcactgatattggggctttcttaaagtatgttgttagagaaaagttggaacttgtgtatagacaaagaagacttcagactctaaaactcatgcacttcatgtcacagtattgagtccttctcaaacactgaccacacagttcatgtgggccttctttctttgtttcacttgctggcacagtaattgtctaaataataaactgtatcttcaggacagaatgggtcaaataagcctggtagtagaggctggtgattccttgtccacatccgcttttgcaagtgatgtgccaacccccagctatgaatacccacagatatccctttttgcatttcatgccccaaacctctccatgggatcaggctgaaaccagacaacagctgcaacaccttaattagcttcttcacttgctgtttccttcttccctccctgcctttctcctaagaggatatcctcaataaatcatatgcacttgaatccttgcctcaggctctgcttctaaggaatccaaagcgagacagagattaaacatttaatatgagattgccgatctacttactgacagaaaaaagcgggtgcagaagccccactcccatgaactcccatagataagaacaagctatgcatcagaataaaaatggatcaactcccttgcttcctgtccgttggcagtccattgtaaaatgtcactttgaccttcagaatgaatggccttatgaacaacctttcagaatctaccctgtccatggcagaaacgctgcagggacatacctctagataattgatggcttttgtttgtcacttttatcctggtattcagtaatccaaaagcacactttgagtttattttagacacagactgtaacactctgcttcattatgaatcgtctcatcatgaaaccatcctgaaatgtggcctgtatataaaaactacctgttgtgaaacatactcctaaatcaaatctgtctttaaccaactatgtaacttagacaagtcattcagttctctggatttagctaaagtatattttgaattatttgattacaaaagtctctttcagctattgtcatataatctgtccttccaaatactcaggtagatcctattttaagtatctctttcttccccaacccaaactctaccctaaaacaaattcagcaggagtctagtcaccaaaggcttctgttatcatcctggcattcttgaatgataaaactagtttgacttccaaaatcacttgtagctgctttcaatttcttttatttatcaaagcttttggtggtaaaggttgaacttagacctcttccttttgtatgtatgtatgttaatgaattactctgtacttgtgtgagagaacattgcatctgtcattgctgtttaaaatgtcatccttgagaaaatgagataggtgttttgaaagaaacccatgatatcactcagatgtaatttttaaatgcccttataatatataactctaccaatgaaaagataaacatttatgataaaaggtagtcatgaatggggctttttgatcctacattatttaatgtgtaatcacagctagcatttcaaataagtttgctccattattgcaaaaggaaaggcagctgggctggagcctcctaattgacccttcatttattcatcctccaagcaaccggagaacacctaatttatacccatcaagtactacactaggtcctaaagattaaatggtagataagaaacagctacttcctgtctcaacagaacagacaggggaaacctttaataaaattaaaaataagaaaaggaaaataaaggaaagtgctaacgcctacaaagtattatgtggcaggcattgttccaaactctttatgtaaattagctccattgatcctcacaataaccctctgagagtatcatgatcttcactttcagataagcagattgaggcacagaagaatgaactagcctgcctaaaatcacacaccgtatgtgggagagtctgttttcaaatccagacagagtgaagagtcctaccacctactgcactgtcccaaaacatcaagtgaagtgagaaaggtgaaattgacctataacagagtggagctcaaagtgagaagtagtgaagtttgtctgaattggagaaaaggcaagggaagcctttcaaaggaaatggggcttgcattgaaccttgacatgttagtttgtattctggacagagaaagtggtagagaaagtacaggtcggaagaacagtaagaggaaatgcagatgtgtgaacaatcttcaagtatcgaagaaagtgtggggaggtgggcaaaagacctgagaactgaaatgcagaaagctagggatcagaaatgactggttttctaggttgagactgaaaactaatttggagccacttataagtagtcctttatatccgggcctaatctgcaaacaataggataatttagagatattatgagatgccaaagaaacatgcaaaaatccatcatagtacaatattccacactcagtatgacactgtgtacggtgttaatttatggttaaatgccagtattgcccatttcatatagggttactatgaggaccaaatatattatgtggaaagcagagggcaagggcaactgatagactggtatgagttgaagatggtgagctaggcaggggtctggccatacaaatactaagaggccaagttttgtattttactgcttatcctaagagcaatggaaccgttctgaataatgttaaggatgttgaagttgtttataaaatgtagtttgaagccaggcgcggtggctcacgcctgtaatcccagcactttgggaggccgaggcgggcggatcacaaggtcaggagtttgagaccagcctggccaacatagtgaaaccacgtctctataaaaaatacaaaaaattagccgggtgtggtggtgtgcacctgtaatcccagctactcgggaggctgaggcaggagaatcgcgtgaacccgggaggcagaggttgcagtgagctgagatcgtgccagtacactccagtctgggcaacagaacgagactctgtctcaaaaaaaaaaaaaaaaaaaaaaaagtagtttgaaataccacatactatttccttaaatatgttagtctgacatattaatgatattattaatattatcaaaaccatagcacacatacttagggggcatcccaaacctcagtttttatcatatacaatggagtgaacgaattcttgcaccacatcacaggattgattttaaatggttcaaggttaaaatgcagtaagaatgcattttaaagggctataaacatgtaggcatttacaatcatcatagttttttccagaggaatgcaaagggttttacacctgccatgccattcatctttattctatacctgtaagctattcttaaccatgttttacaggtgaagacattaaaaggcaggacaactatgttacttgcccaaggtcaactaacctacagcagacccagaatttctaacatttccttcttgaaacaactttttaaatttatatttattttgtagacagaggaagtaaatcagaattctcatgaatttaatgccatattcaaagaaaaacaaaaaaggtaaagtcgtaacataaaggtctttgactccttgcagaaggattctaagatatttgtgtatttaaaggtgataaatatttttatttctatcttttgaccagggtcttataagcaagaacaaaaaccctcacatttagaaataaattttaagagtttccaaatttctttaaaattctttcatatataagaaatataaaagcagttatatgtgctcccgatgatatggtgataaagtgcatttatatcagaaaaagaaattaagacccagcagaagaagctttaaaaataacacttaaaaatgcttttggaaattgtaaagtctccgataattgcgaagtgcgtattaagtgggtaatgcatacctaattataaatgaaaatgctaaatggcttttaaccttttttctacatcagaaaagaactaactgaacaaaagccatgaagaaatattttttctttaatttcttaaattaaaaaagttggtaaattagtattgattttttcagtatcatttgcaaatagcataagcaatgttacaatggatttaatattctcaatttgtcttaatgaaataacagcataaccaccaattgttatcatatcaaggagaaaactttgtctttgcttttaaaaataattcagatcttaaacaaatagactgtaagcagttgcgtggttaaattatagcaagccactgttatatttatatttaaaatcaacagggaagtagattattcaatgctttagcctcattttttcccacactatcgctgctggaaatctatttatgtgtcttatcagaaatggtactttttcaaaattcaggccttctcccactgcctacttctacttatattcagcaggagctagtctttttagttcatttgaataaaattgtgcaggctaagagttgggatgggagaggaaaatataagaaagtaggggatccattctatcaaaactgggagtttctgatttacaaaactgagacagatgcacaagctgaaatgcttgtttattactcatgttatttgacaaactgtttcaaggaatttatgaacatagcacatagagattttgcttctaagatttataaaattggttcaaattacagtgacattttttgcattaaaggatcaaatatttctattgtttatttatatataaataaatatataatacatataaagagcatttataagtaataatgtgtatataattatctgaatttatatccaatattgtctaaaaagtaaatcagattcaggtgtttaaatagcaaatacaggagagaagatggcggataagcagcaagactagcttgcagctcctgctgggagggatagagcagcatgtggagactcacatcatactttgccccagaaactaccccaggaacataccaggaaagccgagagaatccacaaaccctttgaaagaactggatcaccgctgcaggctccctgagatgcagaaaaactgtgagtcggcttgctttctcaatagggaggctggtggtctggggcaggttctcagccctggtcactagctgtctggaaatagactcagtgctgctgggggcgggtggggcatggtgggagtgagactggcctttaggactcacgctgtgtgggggtggggtgaggcctgtgactgcgttttccctcacttccctggtgaactgtatgactcagcagaggcagccataatccccctgggaatataactccatcggactgggaactgtacccccatccctcacagcagctgcagcaagccccacccaaggagaggctgagctcagacacaccttatccctatcccagtctggtggtctttctctatgtgtcctggtagccaaagacaaaagtcataatgtcttgaaagctctatcgccctgcccaccacctgagaaacctgaatacttttgcatcctccgtataggaccacagctgatgcactcccgaagcgccatctcctgactggaggccaaccaacacaaaaccagcgctaaacaaaaacgcaaccaaggaccctcacagagttcacttcactcccctactacctccaccagagcaggtggtggtatccacagctgcaagacctaaagatggatcacattacaggactctgcagacactcctcagtatcaatcagagcctggtagctccactgggtgccagatccagaaaagcaaagcaatcactacagttcagttctcaggaagccccattcctaggggaagcgggagaacaccgaaacaagggagcaccccatgggacaaaagactctgaagagcagcccttgaatcccagatattccctctgacataatgtacccgaatgagaagaaaccagagagacaataatgataatatgacaaaataaggttcttcaactcccccaaaagattatgccagctcacctgcaatggatccaagccaagatgaaacttctgaattgccaggaaaataattcagaaggttaattattaagctaatcaagaaggcaccagagaccaggcgcggtggctcacgcctgtaatcccagcactttgggaggctgaggcgggtggatcacaaggtcaggagatcaagaccatcctggctaacatggtgaaaccctgtctctactaaaaaatacataaaattagccaagcgtggtggtgggcgcctgtagtgccagctacttggaaggctgaggtaggagaatggcgtgaacctgggaggcagagcttgcagtgagctgtgatcacgccactgcactccagcctgggcaacagtgcgagactctgtttcaaaaagaaaaaaaaagaagccaccaaaaaaaggtgaagtccagcttaaagaaattaaaaacattatacagaaaattaaaggaaaattcttcagtgaaatagatagtataaataaaaaacaatcacaagttctggaaatctaggacacagagtaatgtaaaatgcattggaaagtctaagcaatagaatcaaacaagcagaagaaagaacttcagagctctaagacaaggctttcaaattaacccagtccatcaaagacaaacaataataataataataattcttaaaaaatgagcaaagcttccaagaagtttgagactacattaaatacccaaacctaagaataattggtgttcccgaggaagaagagaaatctaacaatttggaaaatatgtctgagagaataatccaggaaaacttcctcagctttgctagagatctagacatccaaatacaagaagctcaaagaacatatgggaaattcatcacaaaaagataatcacctaggcatatagtcattaggttatctaaagttgagacaaaggaaagactcttaatagctatgagacaaaagcatcaggtaacctataaaggaaaacctatcagattaacagaagatttcttagcaggaaccctacaagctaaaagggattgggattctatttttagcctccttaaacaaaacaactattagtcaagaattttgtatccagttaaagtaagcttcataaatgaaggaaagacacagtcttttccagacaaataaatgctgggagaatttgccactaccaagccaacacaagaacagctaaaaagagctctaaatctgaaacaaatcttcaaaatacacaaaaatagaacctccttgaagcacacatctcacagaacctatataacaataacacaatgtttaaaaaaaaagaaaagaaaacagaaaacaaaacaaaaaaaaaccacaaggtattcaggcaacaaaatagcacggtgaatagaatagtacctcacatctcaatactaacatagaaagtgaatggcctaaatgcttcacttaaaaaatacggaatggcagaataaacgagaattctccaataaagtctctgctgtcttcacgagactcaactaacacagaagaactcaaatttacttatagtaaaggggtggaaaaagatattccgtgcaaatggacaccaaaagcaagcaggagtagctattcttctatcagacaaaacatacttcaaagcaacagcagtttaaacaaacaaagagggacattatataatgataaaaggattagtccaacaggaaaatatcacagttctaaatatatatgcacctaacactggtgctcccaaatttataaaacaattactactatacctaagaaatgagatagatggcaacacaataatagtggaggactttaacactccactgacagcactagacaagtcatcaagacagaaagtcaacaaagaaacaatggacttaaactatattctagaacaaatgaacttaacagatatttacagaaaattctatccaacaactgcagaatacacattctattcatcagcacatggaacattctccaacatagaccatacgataggccacaaaataagtctcaggaaatttaagaaaatcgaaattatatcaagtactctctcagaccacagtgaaataaaattggaaatcaactccaaaaggatccttcaaaaccaggcaaatacatggaaattaaataatctgctcctgaatgatcaaacaaaaagctgcctctttgaaaagataaataaaattgatagactgttagtgagattaaccaagaaaagaagagagaagatccaaataaactctattagaaatgaagcgggagatattacaactgatatcacagaaatacaaaagattattgaaggctactatgaacaccttcacatgcataaactagaaaacctagaggagatggataaattcctggaaatatacaactctcctagattaaaccagtaagatatagaactggaacaagatagggatgcccactttcactccttctattcaacatagtactggaagtcctagccagagcattcagaaaagagaaagaaataaagcgtgtccaaattgataaaaaagaagtcaaactgtctctgtttgctgacgttacgattgtatacctaaaaagccctaaagattcatccaaaaatcttctggaactggtaaatgaattcaccaaagtttccagatacaaaattaaagtacacaaatcggtagctctgctgcctaccaacagtgaccaagctgaaaatcaaatcaagaactccacccctttcacaatatctgcaaaaacaaacaaacaaacacttaggaatatatctaatcaaggatgtgaaagacctctacaaggaaaactatgaaacactgctgaaagaaatcatagatgacacaaacaaatagaaacacatcccatgctcatggttggggagaatcaatattgtgaaaatgaccacactgccaaaagcaatctacaaagtcagtgcaattcccatcaagatagcaccatcattcttctcagaactagcaaaaacaatcctaaaatttacatggaaccaaaaaagagcccacacagccaaagcaagactaagcaaaaagaacacactgggaggcatcacgttacctgacttcacctttttctctgaggccatagtcaccaaagcaacatggtactgttacaaaaataggcacatagaccaatggaacagaatagagaacccagaaataaagccaaaaacttgcagtcaactgatcctcaacaaagcaaacaaaaatatgcagtgtggaaaggacatcctattcaacaaatggtgctgggatcattgaaaagcccagtgtagaagaatgaaactggatcctcatctctcaccttaaaaaaaatcaactcaagatatatcaaagactaaatataagacctgaaaccataaagataatggaaaataacattggaacaacacttccagacattggcttaggcaaagatttcatgaccaagaacacaaagcaaacacaacaaaaacaaagataaatacatgggacttaattaaactaaaaagcttctgcacagccaaagaaataatcatgagagtttacagacaacccacagagtgggaaaagatcttcacaatctatttatccaacgaatgactgatatcgagaatctacaaggaactcaaacaaatcagcaagaaaaaaacaaacaatcccattaaaaagtgggctaaggacatgaatagacaattctcaaagaagatatacaaatggcaagcaagcacaaatgggaaaatgcttaacattgccaattatcagaaaaatgtaaatcaaaaccacaatgcaatacgacctccctcctgcaagaattgccataatcaaaaactcaaaaaataatagacattggcatggatgtggtgaaaagggaacagttttacactgttggtgggaatgtaaactagtacaatcactatggaaaacagtgttggagattccttaaaggactaaaagtagatctaccgtttgatccagcaatcccactacttggtgtctacccagaggaaaagaagttattatactaaaaaaaaaaaaagaaaaaaaagaaaaaaatttcatgtgtgtccgtgtgaagagaccaccaaacagactttgtgtgagcaacatggctgtttatttcacatgggtgaaataaacccatgcaccttcacgtgggtgcaggcgggctgagtctgaaaagagagtcagtgaagggagataggggtggggctgttttataggatttgggaaggtgatggaaaattacagtcaaagggggttgttctctggtgggcatgggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggcctgggctcagaggcctgacattcctgccttcttatattaataagacaaataaaacaaaatagtgttgaagtgttggggtggtgaaaatttttgggggtggtatggagagagaacgggcgatgtttctcagggctgcttcaagcgggattaggggcagtgtgggaacctagagtgggagagactaagctgaagggaggtcttgtggtgaggggtgatattgtgcggatgttagaagaaacatttgtcgtatagaatgattggtgatggcctggatatggttttggatgaattgagaagctaaacggaagatacaaggtccgaattaaaaggaggagaaaaatgggtattaaaggactaagaattgggaggacccaggacatccaattagagagtgcccaagggggttcagcataattacttgcttggttggcaagtttttgggctctatccttgagtttttttatgttgtcatacaccaggccagattgatttaggtaaaaacaacactcctcatttaagaatatgcagagtcctcctttttcagcagtaagtcagtcaaggcctcggcggttttggaggacaactgcagctaaagagtcaacttgggcctggaggactgataaagtttgtgattttgaaggcctctaaaagtattaaagcagcagcagccgctgcacgcagacatgagggctaggctaaaacagtaaggtcaagttgtttggacagaaaggctacagggtgtggtcctggctcttgtgtaagaattccgaccatgctaaccatgcctaggaaggaaaggagttgttgttttgtagaaggtgctggggtttgagagatcagtcggacacgattggcagggaaagcacgtgtgtttttatgagaattatgctgagataggtaacagatgaggaagaaatttgggcttgattgaagtaatgggggctgtctgtgaagctttgcagcagtacagccttggtaatttgctgagcctaatgggtgtcagggtcagtctaagtgaaagcaaagagaggctgggacgaggggtgcaggggaatagtgaaaaaagcatctttaagatggagaacagaatagtgagttgtggaggaatggattgaggacaaaagagtgtaggggttgggcaccacagggtggatggcaaaacaatttggttgataaggcgcagatcctgaactaatctgtaagacttgtccggtttttggacaggtaaaatgggggaattgtaaggagagtttataggttttagaagcccatgctgtagcaggcaagtgataacaggctttaatcctttgaaagcgtgctgtgggatgggatatgggcgttgagcggggtaagggtgattagattttaacgggatggtaatgggcatgtgatcagttgccagggaaggagtagagatgtcccatacttgtgggttaaggtggggggatatgagaggaagacgcgaaggaggctttgggttggggagaagggcggcaatgagacacagctgtaatccaggaatagtcagggaagcagataatttggttaaaatatctcggcctaataagggaactgggcaggtggggataactaaaaaagagtccataaaagagtgctgtccaagttggtaccagagtgggggagttttcaggggttttgaagcctggccgtcaatacccacaacagttatggaggcaagggaaacaggcccttgaaaagaaggtaatgtggagtgggtagcctccgtattgattaagaaggggacggacttaccttccactgtgagagttacccaaagctcggcgtccgtgatggtctacggggcttccaaggcaatcaggcagcgtcagtcttcagctgctaagccgagaagatctgggaaggagtcagtcagagagccttgggccagagttccaggggctctgggagtggctgccaggtgagttgaacagtccgattttcagtgggttcctgcacagatgggacgcggcttacgaggaatcctgagctgcgggcattccttggcctggtggccagatttctggcacttgtagcaagctcctggggaaggaggttctgggggaacgcctggctgctgcggttcaggtgtttggaagttcttgtgtgctggagatgtggctggggtttgtgtcacagtggaggcaaggaattgcaacttttttctattattgtacaccttgaagacgaggttaattaaatcctgttgtggggtttgagggccggaatttaatttttggagttttatttaatgtcgggagcagattgcgtaataaaatgtattttgagaataagacggccttttgaccttttagggtctagggctgtaaagtggctcagggttgctgccgagcgagccatgaactgggctggatttttatatttgatgaaaaagagcctaaacgctatctgatttgggataaagaaaaagaagcattaaccttgactatgcctttggctccagccaccttttaaagagtaaattgctcggcaggtggggaagagctagtcacagaacgaaactgtaagccagaccgggtgtgaggaggggaggctgaggaagtattgggacttagctgggtctggcaatgagcagcttggggaggacgggaaaggtcagatgggtctgtagaaaaggaagactgggaagactcagcgatgcttggggttgggaccaaggggacaggcgggagggaaagaaggaggatctgggaggaatcgcattgggaacagaggctagggagggaacgaagtgtgaaaaatgcctggacgtaaggcacctcagaccatttgcccatttttcgacaaaaattatttaggtcttgtaggatggagaaatcgaacgtgccgttttctggccatttagagccattgtcaagtttgtactggggccaagcggtgttgcagaagaaaataaggtgtttaggttttaggtcaggtgtgtgttgaagaggttttaagttcttgagcacacaggctaagggagaagaaggaggaatggagggtggaaggtggcccatagtgaaggaagcaaacccagagaaaagagagcgtagagacacggagggaaggggtttgggggttcttgcctcctagaaaagtgggacttgccgctgagggtgaaggagaaggggttgaggggtacttggccctgccccaggaaagcgggacttgccgctgagggtgaaggagaaggggttgaggggtacttggccctgccccaggaaagcgggacttgccgctgagggtgaaggagaaggggttgaggggtacttggccctgccccaggaaagtggagaagaggtagagaggtaggaacaaagagcaggaggacgggggattgatctcccaagggatgtcccccgatccgagtcacagcaccaaatttcatgcgtgtctgtgtgaagagaccgccaaacaggctttgtgtgagcaataaagctgtttatttcacctgggtgcaggtgggctgagtccgaaaagagagtcagcgaagggagataggggtggggctgttttataggatttgggaaggtgatggaaaattacagtcaaagggggttgttctctggtgggcaggggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggtctgggctcagaggcctgacaaaaaatctttgcacacacgtgtttatattagcacaatttgcaatagcaaaatatggaaaccaacccaaatgcccatcaatcaacaagtagggtaaagaaaatgtgatatatatatatatatatatatatatatatatatatatacacacacacatatatatataacatatatatatatatatacacacacatatatatataacatatatatatatatatatatatatatatatatatatatatagcatggaatactactcagccataaaaaggaatgaaataatggcattcacagcaacctagatggaattggagactattattgtaagtgaagtaactcaggaatggaaaatcaaacatcatacgttcttattcatatgtgggagctaagctatgtgtacacaaagcataagaatgatacaatggattttggggattgggggaaagggtgggggttggtgagggataaaagattacatattgggtacagtgtacgtggctcaggtgacgggtacgccaaaatctcagaaatcaccactaaaaagcttattcatgtaaccaaacaccacctgtttcccaaaaacctattgaaataaaaaaaggaatataaataaataaataacattattggaacaataagaaagccaaaaacaaacaaataaacagcaaatacaaataataaagagttttgatggaaatccattgaaatgttaattatgttttaaagcaggagtgtccaatcttttggcttccctgggctacagtggaagaagaattgtcttgggccacatataaaatacacaaatttttagctgatgagctaaaaaaaaaattgcaaaaaaatctcataacgttttaagaaaatgtatgaatttttgttgggccacattcaaagccatcctgggttgcatgcagcctgagggctgtaggttggacaagcttgttttaaggtattaatttatgctcttcttttccctagaagtataatatatacagaaaagtacaaaaaacatgagcagatagatcaatgaagtattgttaagccagatccaggaatagatatttccaacacccccagaaggtccgcccattatatccccttctagttatgacatcctccttctgcctcaaagatgagccatatcttgacttgtgaatttgtaattattattgctttttaattttatatgaataaaatcatgcaatatataatatattgcttcaagtctggcttattagccaactatgtttctgagatccttttatattgttgtaggtagctgtagttcatttttctgatcacatataatattttattgtatgaatataatgcagtttatgtggaacttttactgttattggaaaattgtattatttctaagtgcattcttctatgattattcttgcacatatcttttgggagatctgtgtaaatatttctctgttgtatataccagaaatcagaattatcgggaaattgggcatgcatatgacaattttaaaagataacaccaaattgttgtctatagtgattttattaatttgtactctttccagtaatgtttttttctatattcttgacaatatttgatatgatcagtctttttaaaaattttagccttttgcagggggatagtaaaaagtatctcattttggtttagcttctgtttcctgatcactaatgaaattgggcactttttaaaattattattggctatttggaaacctccctccctccccttggtttctaggaataacttaattcatttttccatattttaattgtgttgtctttgttttcattagtgattgattctagagaagagcacaatgttgcttttttgtgtaggaaaccgcttctactgtgtcgcttgccttttcactctcttaatcatgtcttttgataaacagaaaaatttaaatttaacatagttcaatctattggtctttttctttttgagatgttttttgtaaaaagtttaagaactgttttccttccttgcgatcatattttcctgttatcttctatagtgtattttgtccttcgtatttaaattataatgcacctgcattttatttatttattcatttattttcatggtgtaaaattggttcaatatacaatttttttctatagggatccaattgagccagaacatatatgaaagatgcagtcctttctttgctgttctacagtgccattcctaaagggaattaaatctgcatgcctgcttgagcctgctattgacctcttttttctctcttcctttgttgtatttgtaaatgccatattctagtaattactgcagtcttacaataagtcttaatatctgatagctattaaaatagactatatggtttaaaaaaaaaagaggcttgaattgtaagtgaaaccaaaggagaataaaatccaaagagaaccagaggagaataaaaattcatgccatgagatccaatccattatgaaaattgagctttaaaaagctttagaattagtgaccaaggcaaagagcggtacatatctttcattggataaaaatataacaactgtttctgtgagtataatcaccctgagtataaaaagcccgagggaagcttctcctgtgaacctgcatcaagagcagtgggtgattccgtggattatagtcccctcacagacatgcaatgctggcttttttatggtagcttcctatagcatatctcaaaaataatagctaccatgtattaggtatctattaagccttttacataacatttgttaaaaaaaaaattcccaaactatgtgcctggtttgctaccactatagccaatgtcactgggcatctcactattctctgactgtagctgttacaagagcatcaatagattctctaaaatgcagacaatagaaaggagttgctaaatttgtcaaattttaagtgaatctactgcttattttgttggtatgttgggtggctcttcttggtggaaggctcacaacctgtaactgactccagagcttctgcttaccaatttcagaaaactaggtttcgagtatttcctttgagcattccttcatgtgcttttatgaggctaactctccttccctatttccaagatggatactttgggaaggtaacatattctagttctcaaattgatgtaagtacatttatgttactttcttctctatttttgtagcagtgagggaataatgggaatttatacaaataaaccacatgagtatttcaagttctgtgatgttgatcacattctctgtgatgtatgctttagttgtatcttcctcaaagtaagtaccaaccttcctacagttatttctaattaaacaggataatctagtttaatcctcaaaactaccatgtaaaatagaagctactattataatttcaattttatatataaggaaaattaagttcagagaagtgaagtaatgtgcccaaggacatcaagaaatagtgaagttgggcctgtaatctcagcactttaggaggccaaggtgggtggattgcgtgagttcaggagtttgagactaggttggccaacatggtgaaactctgtctccactaaaaatacaaaaattagccaggtgtggtggtgggcgcctgtaatcccagctacttgggaggctgatgcaggaggatcgcttgaacccgagaggcggaggttgcagtgagctgagatcgtgccattgcactccagcctgggcgacatgagtgaaactccattgcactccagcctggacaacaagagagaaactccatctcaaaaaaaaaagaataaataaatagtgaagctaggatttgatgccagacattctgacatcttaaccgcttccttaatcattcaactaatgcttgtcaaatttaatgtgcacaggaatcacttggagatcttattaaatgcaaattctgattcagtaggtctaaagtgaggcccaagattctacatgtttaacaagatcacaggtaacactgatggtgctgccctggacagatatcagacggtgggtagcaaacagtctcaaaatgaaccttaggttaatgtctaaagacaatcaaatagcattaccataggggtcaacacaaggtgatagaaggaatagctctattatgatgtaaagaaatcttagggaaaaacaaatggtaattggtatttcccaccactaagatggtcattcaactatccatttatgcatccaaacaatgcatatttattaagcacctaccatatgtgtcaaacataagtgcaagcagtaagtaaaataaggtctattttctgtatttatacatctgccaaagtataaatgcagactcactttttaaaaaaggaattatatgaatgccattggaataaagcaccaggaaaaaaatgtgcttgagcattaaccaaagtaataggttttcaaactgtatttccttgccagaaatactatcctcctaggcagtgtttctactcatgacagaaaatgcaaataaggaagagtctccatctatagacgtgatttaacaagtcaattgcaggtgtttttcctcctttttgagaattgtgcggttgagagatctactttcacatacatattaatgagttgttttgcataaatcaattctatttttatgaatggagattatataaccctcctgtaattcttccagaaatcccatccaaacaagctactagagttcttagtagggtatgtcccttgagcacaaaggattttattttaattatttcatccatttttaagcaaaagtaatcaaatataaacaactgtgctggaggctgcaccctctgccagctgcctctcagccttctgaaaggctctgtttttgtgttgtttctgttttgtttttttgttgttttttgttttttgtttttgtacttttctcagtactcatttagaaagcaatcctattgtttttatttaaaaaggtgtaaaatgtagctgattcaaactttaaaatttatgatattcctctttggcaagtctagctgactatgggccctgaatattattattgctataaatattaaaattaataaaagcttatatgtgtccagtaagccaaaatatgggaaaacatttcctgagcttgcttaaattttcacagcaagtgaatggcagagccaggactttaaacctcggtctaatggacaacagaaatcaggcttcaaacacaacactggcatttcaaagcatgtcccaggtggcagatgtcctaaagaagcatctcacttctacctgtggttccagttagctcactctatcctccaccttctttccatagttaacaggggaaaatgtcagagtctgtgatgcactggataaaattgtcctcccctgagctccacgttttcacagctggagtgaagaaggtgtcttggcaagattcccacaaacacacactcaaaacacacatcctcactcccatatttgccttgacatcaccatctctgcttttacgaggtcttgactcctgtgtacataaggcagcaagcctggaattcttaggtcacccctcattgcccaaaccttcatctacatagagctctgaatgttcccgtatctgaacccacttcccaatcctccgcagcttgtgaaattcttccttgggcctcctaaaaccaaaatcaataattagcaaaatctttgcacacttaaagttttccctgaaagtccccctgactgtgttgcttcaactgacatttggcttccatctgaagatgcttctcctctctggctgaactgctgattcttttctccaatacccctcttaccacaggtctgtcagtagggatagagtcgtcccatctcctccgtgccatttccagatgatccctcctccctcatatctaattcctttgccattaaaatcatgccattagcccgcactactcataacttctctttgttgcaatcatattctcatcccctaaactccaacatttcttgaagattttacctattagctcactgtcattctctgcataatactcctgtcgaatatcttggccatttcagcctttggtgaatttggtattcagtactcaatatcctgatttgccagtttcttgacttctttcgttctgttgcccttgtttatcgacccatcttagccaatagccacgctgctaagatgactcttttaagactttgtcaatgtctaaagttgccagttccacccataatctgattttcaaccttcccaaatttgactgtctgactcactctctccagtccatggactccagcaatactttgactctgctagatcctataattcacgaatcctaacaactactcctgtccttctcctgcttcgtcttgtcattccctctatactgagacaaaggcaaaaaacacttcttctcattaacttttaactcacttgctcatcacttgcacatcaatgattcactttcactttcccccttatttcattcatctggtgaaatctaagccatgatgaaatccaaaccaaaattttaatctagtgaaaaatccaactatgacacctgctttcactttccaattaatgaccaccgacatcagtggtccattcagtgggccattaatgttgcctgacattaagtcaccatgaagctcaaagatgttactgtattgccggcatcttcagtctagaaaggccctctgtaggtggaaaaaagtatgagctagtatttttctcctataaaagtcaactaaatcatcctcacatacctcaaacaacattttcctgaccctttaatataatttatgttataaactgcttgatacttagttctgattcaggtctgactcattgcctagtccctgagccaggatggactttggctgtacttgagatgtcaaggtaatctggcactctgactaactagatgtgtttcagttgcttacctctagagttatttccccaaaataattccaatgaaacgttaaaacacacaacaaaggcagcctctttctttttccaatcccatctatcacataccattggatttctgttttgctacaaagtcctgaaggttttggccttttatttttatctcacaacctaggcccacttcttaaacattgcctagcttgcctttcccttttaaaatctgccaacaatcactttctctgttgaaattatctcttcctacatccaactgtgggaagaacagccttttcattgtgctgttctctgaggacaagaatagaagcacattttttaattcttatttttgtgtgacttttttctgcttagtagttaccagtttttactacaattgtgattcctgacaatatataacatttagaaaataaggaaaagctattaataatatcacctgagccagagacaaccactgttaacattagtagattcttctaaaattttttcttatacaaatcataaacacagatggatgaatatttgttaattgtggataactatttcactttacggaaataatacaacaaacactttaaaacattttccctactagtcattttagaggatattttaacaaaaataataaaatacggagaacaattaagatttcagaattttcaaagtttgcatattcatgatctgttttttaaaattcaggtctcctgactaagatgcttattttactgcagagaaataagcttttgtggataccacactcaaggggaaagacaggcttattctcgaagcaaatagagggtccttcctgccaatatgacctagagaaacagacaaatagtgagaagatgcatctccgagaaccttcaggctgggccactgtaaatccggttggatttgactcaacccagggcataagtaatgttctcagggcatttccttaacgaagactccctattgaaagaaggtatagcatgaacaatgtcgggaagtcagaatgcttaatttctgcattttcttcctctgaactgctaagattgtatttagagacaggtagagtcctatgtgcgtgttctaatctagttaatttacttcaatcatcctcttttattttgccagcaggcaaagccccttcagaatacctaattattattccagactcctgtcttagttttcatcagaggacttgtatatttcattagcttcagtccttgtaccacctctccttaccaagcccagcattgtgacaccatgtcctttacccttgtgtttttgaaagcaaaagaagaaacgcatacatttttattattcattcttttatctcactagtcttgttctgcgaaaatttgagatctcaatagatagtgaaacagtctttcacccttttccatggaataaatagttattggtgtttatatactctataattattatatgttgataaatggttatgtaatagctgcatacagggaggaaaagtccttgcaggtaattttgtctgctaattacatataaattggttaagcagtcatgcgtattgatgacatcgttttcaactgatttgacttctcaaaattactaaacttctacctggtcatctaaggcaggacaatttttccccaggatgaggggttggagggcagtggtttcagcaggtattagattctcataaggagtgcacaacctagatccctcgtatgcgcagttcacaatagggttcacactcctataaggatctaacaccgctgttgatctgacaggaggcagaattcaggcggtaacactctctcacctgccactcacctcacctcctgctgtgcagtcagatttctaactgtctatggcccagcactgcagcccagtggttggggactgctgatctaaggaataatctcagtctttgtctctctttatccaaaacaaccataagtctattatataaaaataatgtatgtatgtatacattttgcatgtgcttacatgtctctgcgcacacacataaatttatataaatgggattgttctagtaaccgacatttttctttaaaatttttaagttataaaaaatttcaaacatacagaaatgtctataaaaatattataaacagatttttatttaaatgtgtgttaatgtttttgcatttttgcttcagatcttttttaaagacataaaatataccaatactgccaattttcatctcgtgctttctttccctcccttcccagaagtaaccgctttcctgaagttggtgataattttttgaagtatggcttgaaatttttattgtctttgtttataatatttatataaatgtcatcagagtacaatttctttggcacctttttcactctacattcagtttttgaaattcagccatatttctacgtgtttacttattttaaatgttgtgtagtatttcattggattaatgaaagaagtttacttcgtttcaacgaaggaatgagaataaaatttaatcctgttttttcaggaacaatacactataaaggtatttttatttatatccatcaatttcacttatttttattgagctattatcatgtgtcagactctatcatgtgtggaagttacagtgctgataaaacaaacacatccttgcctgccatgagtctacgaaagcagtaggagagggatcacataaatatgtacagcataaaaaatgtaataaatagtctgaggagactctgagagactaaaatgaaaaagttatttattggaggctcaagaaagcaggattcaagatggatgaaatttccaatgaaggaaaattaaggttcatcaaaattagttatctgttagagttttttgtatctaatgccacagtaatgtgctgaaacaaagcatgaaaaaaacccatgatgtccagcagtaaacatttatttttggtcacgaatttttggtttactcggtggttcctctggtcttcttggggttcagttttacattggtggtcacatatgcagttacgttaatcttgctgggctaattcattacgtattgttggcccaggctggggcaactgcagtgatttatttcttctgcacatggcctctcatgctccagcctgctactccaggcttttaccatggtagctgggtggggatccaagagcaaggggatagaaggctacacagctacttgaggcatatgctcagaaccaatatattgtcacttctgctgcattttgtttgcaaagtcagaccagattgaggaatggtgaaagagactatgcctctgatggaagatgctgcaaagtcattgcaatagggtacaggaaggtgaaaaattaggactaagttgtaatcactctcccatggtgatatgaggaatggggtaagaatattccatagacggaaacaccacgtttaaagcctatgaaattggaaggggctacgtaagacatttgaaaatggaaaaaaaaaaagaaagaaagaaagaaagaaaggaattgtggagcctattgaggaaaaaagggaatggtgtcagtaaaagctggagaaattggcagggaccatattatgctggcattattgctaacactcaggattttgaattgtatcctaggaacagtagagctccatacaattttaagaaatgtattatttaattgatgacgttacctaatttattacatgatttaatcgattatatataatctaagtttaaaattatttttattatttcttagagtcaaggtctcactctattgcccagcttgagtgcagtggcaccatcacaacctactgcagcttcaaactcctgggctcaagcaatcgttttgcttcagcctcctgagtagtagctgggtccacaagcttgcaccaccatgactggctaattttttattttattttattttagttttagttttattgttttttgagacagagtctcgctctgtcatccaggcttgagtacagtggagagatcaagactaaccacaatggggatccacctaagctcaagaaatccactcagctcagtctcccaagcagctgggaatacaggcgtgtgccaccatatccggctaatttttaagatttttttgtagagacaaggtctccctatgttgcccacgctagttttgaactcctgggttcaaatgatccttctgtcgtggtctcctaaagtgctgcgattacaggcatgagccaccaagcctattatagaatgtaatttttaattaaagttatttgctttatctgtattaaaatatcttaagaattataattttctaagttatgaaataatctgggagcctattgagtcattaagatgttagacgtgaaagtgtgggtgagaggtagcaatggagactaagaaaactgagatatgattgagaaattttggatgttaaaccaataatatttgctatgaggtgggatgtgggttttgagaaagaggatagtatcaaatatcgccaaatggataattgatatttattatttactttgatgaggaagacttgaagaactactttgaataaagaattaagagttcaatttcagagatgtcctgaggttggatataagggtctggattgccaacagaaagtctgtgctaaccatatgaatttgagaattatctacatataaatgttacttgaagccttgggagtagttgaagtcaccaggagtaaatttttcaatcaagaagaaaagaagacaaaaaataaatcccaaataattccaattattagacatcagggaatataaatagatatgttcatggttttaaatggctacatatcatctgattatatgtctttaccataattattctaaataaatgtctcttattggactttgttaggcttcattagacagtaataaaataactatctattatatacttctttactcatttgccaattatatccgaacagtagatactgggaagttgaattgctgggaaaagtaggttatacattttaaatgtgaatgcatcttgattaacaacctttgaaaaatggttatgccaaatgatactttcaacagcaccacccgaatatgctattacatcaatccctcttgatattatgtattgcttaatatgtacccttagcaatctgatgggtgacaaattcttgttgttttcatttggatgtctaggtttatttgtaaaatcaaacttttcttatctgtttattggcaatttaaaattattttgtaaatttcctaaattgggtctttgcctagttttctgttgaaggattcaaattcatttccaggaattattttaaatatgttaatatttttcttttacaaattatgtgaaatgttcctatttttattttaacttggctagttgtgtttttatgatacagaaattttagcaaagaaattgttttgtaattcaatttctctctcattttctttataatgctttttgtggcacatgcagaaacattatttaagccctatgattgtaaaaactatttttggtcagcactcttataatttcattaattccttcgaggccttcgattcaccttgaattttttgtaatgagcctgaggtaaacacccaaccttgcttccccacccctgccctatgaaatttccccaattccatttaataagtagttcagtgttgacagagcccattttctacttcaaatccaagaggttttctgctgtggaggcagtacaatatagtagttaagagtaaagttcccaattactctaaataattttcccttcacacccctcccggcagggtagaacactagctggtgagagcgagctattctacaaagctcaaagctacaccgaagggtcatatttctcctctagagaaagcccatttaacaacaaaagacaaacttttaaaatggcagcactgcctagatactaatggtttctgatgccttattcttcctgtaaataggtcagatataaaggtttagaagtcagcattaagaccaaatgcagcatctaaactagagaaagtgagtgaggaactgccttgaagtccattctatcaatttcattttaacctgatttatttggctatatgtttgccccctctgcatttcctatatcagctccatcacaaatcagtcccctccaagttgtattggaaaagcaatatatgtgattgagatattgttaacaacaaagccaattctggtcccagagctgttagattgtgattgataaaacttaatattttgaagggaggaagaaaaaaaacctattattccagttcttttatttgtagtgtgggtgaagttccttttatctcctctactttcattgtagcagtatgactgaaattccaataaattattgaatgcaatatccagatgtccagatgattttttggtgctgctgctacttcttagtgagcaagacaaaagatagttgaggttctgcaaaaagtgtcaaagcttagcaataaaataagatttcattgaacagaaactaatggaatcactcaatttatttccctttcactgttgtaatgcagggaaatcttgcttcatacgagtcacaaagcttgagtgtgcagtggcctggctctggcattgcatggtttgtgtgtgagggattggaatacctttaataaaaaagcgtggggtgaagcagcttagtctttcaaataaaagaagtttcagtgtctgggcatcatggctgtttaaaagtcaactttttcaactttttctcctcgtgtcacctttttaatattcttggggtccctgaagacctatatctccagttcatcttggcatacttaggttcaggttttatctgctccatggggacagctacctttttcttagagtgcttccattttcttttctcagatgcactttgtagctgtgtcatagattagccaagcatgcctgattgagatattaatctgaaggagtgttggttaagagacagaccagtggtcagcaaaccttttctgtaaagagccagatagtaaatatgtttgattttccggccaatgtctctgctgttattgggtgaaagcagccacccataaacccattaatgtggctgtgttccaataaaactttattcacaaaacagacagtgagtaggatttagctcatgggttgcagtctgcagagcactggagttcactcagaatactttatagatgtgtcctaccaatgatgactgttaacatttattaagcatttgctaaaaattctccttagataatctcatttctcatattatttactaaaactaaagtgtgggtactatttataaccatgtttatagataaataactgaagaagacagaacaagtaatttactagtacatggtagaagggcatttgaactcaggctcactctagggcccaagcttctaaccactctgccataatgcttttctcattaattaatagaaatgcaaatgctgtgaaaatccattttgttaagatatttttgtctaagtaagttttttttgtttttaattaatgacgtgtcacatatgtttcagcttactattcacaggacactagattactattattatttaaatgtaattatttaatttctattttgggaagattaaccatgaatttactggcagtggaaaaacacaaaggactaaatacaagatgcataaagtcagcatgaagagatgaaaacagacagggatgtgaacttacatgagttgagtctttaaattctggctctgtcctttacaatgtatgactttgcatgttacattctgagccttaattttctcattcatgaaactagaaaaacactagctctatatctacatcaaaattattttgagaatctattaaattacctaatgtagacatgcttgtatagatgtatccatgtataataatatttgcagtatactatatgtaattatatacatacacacacatacatacaaacacacaatagtatatattagtcatttttatttagaggaataaagaaattctgtgtttaaatgatatgttaaaactgctttgaatttggatcaaaatttagagtagattttcacaggttctgaggcataaagagttcttaagggtcatgtaggccatgcctctgtcttcaggaagagatatccttaagccaatgcagatgagatcctgtctatttcttttagagaaacaatttagtgaaagtgcctataaaccatttgctgatagaaagacaacctcttgaatacaaattgactccctgattgcaagtgactttgtgatgacaagcaagagaacttttcacaaacacagaatatcaaaaacattttttgtttgtttgttttcgggagtcaattgcctgtgtgcctgtggcttccggatgggggttccgattcaaaacatccagaggctccatcagtacttactatgcaacataacacctcttagtgtctagaggtgagtcttaatattttataccattaactgtgtagtcccaaagatagattcagggcagatgtttgatgtttggtttgctgagtaccatagcgagtttctctgcctatctttgacatttttgtagcagtaaccacatcacccttcttaatcactggtgctttagataataattccctcaaataaaacaaaaactgaggtgattttataacacattatgatatggtttggctgtgtccctgcccaaatctcatcttgaattgcagttctcataatctccacctgttgggggagggatcctgtgggaggtaattgaatcatgggggcggttaccctcatgctgttctcttgataatgagttctcacgagatctgataatttaaaggggcttttctccttttgcttggtacctctacctgatgccgccgtgtaaagaaggacgtgtatgcttccccttctgccatgactgtaagtttcctgaggcctccccagacatgctgaactgtgagccaattaaacctctttcctttataaattacccagtgtcaggtatgtctgtattagcagtgtgtgaacaaagtaatacacattatattctctcctttttgaagaaaaaattaagaaactggctgttcaaacttaatgtgaagtatcagagaactctatgtgcgatggggaaaaaaaaattagagaaacattggtttgccaccagtggaaactaaccagtcttgtctgtttagttcattgttgcattttcagctgctagagcagtacggggcacattttagttacttaataaatttggcagatgagacttcctttaaatgtctacagcacaatctctttggctttctgtgaaagcagatctcatggcgaagacatggactatgtagtgtatttaggtggtattctcagaagtatggtgaaggagtaggtaaatagatagcaaaaggagaaaacccaaaaactgatgaagaataaggtaattaattggttgtcattgtgggcaattgtggctcagtacagctgagtgccccctacagctatcaagcacatctcattattagcccagcataggccaaggaaactgggacatttactcattaccttctgtacctcattggttaaggatcagtcctcaggacttcaatttctggtaacctggcctgctttctatgtagacaagtatgtgtctgtggaataaaaaataatttctcagagcattctcaggcagagcaacccaaatggaggcagcaaaccctctaacgtaactgtcccccaatgtgacaggtaacttcctaaatgggttgaacagatatatgggatatggggcacctacagtggctgctacaatcatactttaaaagaactataacacttttggtttcccatgtgacagtcataatgtgagaaaattcaagaaattagcttgatatttacattttatcacataattttaatttaaaaggtcacatgtaataagacaagaggaggtgtaaaagttcagagatagcagttccggaatttcacattttttcccgtatacttggccctagtatttctatgagtaaataggttagtttttagttgttcttggtaaattactggatatgcgactggactgcacttatgctatccttcaaataaatgaaaaacccaattgagacaactggacagtgatctcctggattaattattatactgaagatgataattacagtttctgcctgtcttataaataagcagtcctcagttgccaaatgggcaacctcttttctgcagttacagatgtgcggcattaaacatctcaaaaatccgaagtaagagtcacaagaggacttcatggtaggctcaggggcagagaagcttatgcagtgttgtggctaggataagccaaagcaatatgcagtctgagatgttatgggggcatgaactataagtaaaaacaaggagactgatcagctgggaagacagtggagcagatattcatgcaaagcagagttaacagagactgggacacctgtagataaaggaacctagagagggaggaagagaataattggcaggtgtggcaagtgtccttcctgttcccagatatgcctcctgcactttgttggtctaagatttctcttgatcctttttaactccacccccgctttagtttatactactttaagtgaatttcatttcctggcatgtaaagagacctggcgcaaacaatgaacacacaataatcattgtagcagaaattgaaatgaactagaaaatcaaccagttggtcgtttaggccttatggcattgtgctaaagactataggtcatactttttgggatttgaatctttgttctattaattagtaaccagttcagtgaccttttggcaagttttttgaacatttctgggatttagcatttcatgtgtaaaatatatgtaataataataaatatttactgtacaatatgcttgtatagtacccacatatatagtataaattttatgaagattaaatgtaaatataaataaatccaagaagataattggtataataaaaagaaaaataactaaaaaataaataaatgtaataattaaatctacatatcgtttaaatcaactccaagtctttgtaagagttataagttatttagggccatttgacatgtagtttttaaacaagttacttatttcatttaagtctcacaacagtcaaataatatacctattttcagaacattttatagatccattcacccattcctcttttcagcaaatgttcttgagtgccctttgtgtattagacactgagcatattcagagaaattgaaaaaaaatgaaaagtaccattttaaatgtctcacagcttataaatccaagcacttcattcaagcacagatttatctgactccaaagcccaaacattttccttcaactatgtgaacactctttttatgtgaaataagcaagctttccatctgtttgagggtttttctgtctcccctgggccccagtctcttataacctaattttggaagtgacaagccataatttgaccagactcagttggttgtgcagactaatgctgacacaatgcggcaatacacaaagtggtggatattggaagcgagttcattcggggccgttttgcagcctagctaccacatgtttccaggtcgatcctagcctcttctctaagaaacctttaatcagacaaatttggtcttttgctctcttcaattcctaaaggaaatattgtagactatgtttgtagtattttgtatgcattcactcgctttagaggtataattatttcttaatttattaaacatgttcttgttgaatacctgctttttgcaaacactgaactcgcgggaaaacaaggtccctgttttcgtgaagcttatggtctatttagagcacactgaaataaagtaaatcaataatcattgctgacagtgactgggcctttggggaaaaatacagagtgatagggaactgctacgttagattggttagccaagggagggttcactatgtggtagtagcaagtaggctgagatctaaatgtcaaaaagaatctagaatgcaaagatctgggggtaagttttcaagcagaagaaacaagaagaccaagggccatcgggggaagaaactcattatgttccgaaaaacaggaaaataaaatggcagctgtatttggaatgttctgaacacaggtgaaaggatggggtaaacagggccatatcatatggggctttaagtaatttagtaaactatttaaagtcatctttatttctctgggttgactgatcattaatcaaatattttttgagtacctactgtgggccagcacttactggtactgcaaaggtaaacctgtacacattttgtggaaaggcgctgatacaaacaaacggtggcagccaagtagggttattttttgaaaagattttataaatacatgagttagtgaacaaactctacatttaaattactgttatagcaaattataatgcaatgcaagcagttcacctctttgtaaacttattgaatcagccaacatgtcctgaaccacctgtctttgaggagcagccacatagagagaggttgagtggttgatgtcatttgggactaaaagttccagtttcagctttgactgtaacctataacttaaaccagcttcatctgtatttttaaaattatttttaaattttatttttaattaactaataataattgtatagatttatagggtaaaatgtggtattttgatgtatctttagattatggaatggttaaatcaagctaattaaatttgtcaccccacatacttgtcattttttgtggtaaaaacatttaaaatctactcttctagaaattttggagtatacaatacattattatttattatttttaccactctgtgcaatagatcactaaagctttttcttcctgtttcactgaaacttcgcactgtttgactaacatttccccatttcctatgcacccctctcccccagcctctggtaaccaccattctactctctacttacatgaatttaacttttttgattccttgtatgagtgagatcatttggtatttgtcattctgttgctggcttattttacttagcataatgtcctccaggttcatccatgttgccacaaatgaccgaatttcctttttttttttttttttttggctggatagggatagtattttattgtgtatatatgccacatttttgttatctattcacctgatgatggacacttaacttgcttccatgtcattgcattcaccagaatgcagatatctctttggcatactgatttcaatttctttggatatatacaagaagtgggattgctagatcatgtggtaattctatcattagttgtctcagctagcactctctgcctcttcacctctaaatgaaacctagtcactgttctctggaaaaatcagtgtccaggtaattccagtgtaacccaatgaacagacatttccatgactacttctggctccaacttttgctgaagtcccattctctgctctgggtcttacagttttccctccttctccatcctggttcttactcaagagtagaaatgttttcttaattctgtccctcacacaacacacttgataaacacatgtctatagatttttgtttgtaacaaaatgtttgtagacatttaggggaggagtattggcaaaagaaaacacaaattactataagcagaaaagactatttctaagagtccttcagcattctatatcttgattttctttttgtttctgttctctcccctccaccaaatccttcatcatggcaaatgcagtcagaccactttggttgtctcaaagatgtcttgtctcctgatatgccatgtcctctggagctcagatggcccgttttcctcaacaaggtttttcagctttagcctgaaacacaaaaaacctttgtgttttttgaaatatcaatgtactgtctgtactatgttttatttttcccaaattgctttgattttttaatgagtaaatttgtttgaaaaaacatatttattaccactgtatctagaaagccagtgtcattcatcacaaatagaacaaaactttaaaaggcaatacatagttatataaagttaaaggtgtttttttttttgcataacacctaagtgcgtcacccatacaaccagtgatatctctcccacacattggtaatgtctcttctgcttatctctcagggttactatcaacattaaaaatgatgacagaaatgaaaatgctttggaaaaaagtgagattttatttaatagtctctctttccctccctccctttatctaaaccataatgcatgcaagggtccttatcactgaacctaattctccttagtgctgagctggagaaagctacaaagaaaatgccgattgcagctgtgattccaaagaccttgcttggactaagaaaattcaacggaaaaatgtcagtatttaccatcaaccctgcagtcactctcccgaattccagttgtggaagttcttgcaaaccgaaaccagtaggataaaaatctctggtaaactcagagcttatgtccatgggaagtctttaaaaaaatgttcttgcttcacgcttcttgtataaacaggagcattaagacctttacccaggagctctgtcccattacctccaaaactcggccttttgtattttacataggttgcaaattttgcaatctaactttctgattaaaccatcacaatgaataaaagggcttattaagggctctgtctatgaaggaccatagcaggtataatggttcgcataaaccactctttccaagtgacctcgggcctcactccattgaaatcactctcctttactctaatgagagtcacacatgtgaatcaagagggagctataaatgcagttgttcttggaagggcacaggtgcacctaatttgccaccaaaaccaacaccttcagccccctttgctgatgacctggcccaggagtgaattacaagtgagcttctggccagactccctcagacctctgggaagccagtggtcagcctggcccttttttttttttttttttttttttggagacagagtctctctctgtaacctgcgacccccaggttcaagcaattcttctgcctcagcctcccaggtagctgggactacaggcacacactgccacgccccactaattttttggatagcctgaactttcttgttacctaccacctgctaagacttaagtacaaggtcaggatgtacttcccccagtgacagggcagactctgtttgcttgctcttggataaaaagaaactgtttgcagccctctttttcctctccttcctcactttttttccctctcccaccattgagcagggaaagtggtatcctgaatagctgaaaatgaatcagagctgggtagtagtccctattcaataaaaggcctccttttatttttttagttatgtggtcttgagcacattgcttaacctttctgagcactggtgtgtatatttatgaaatgggagtcatatggggtacctacaactcattttgtttataaagttcaggaattgggaaggtctcagtaattaagaggtccccggctcctgtaccaggaagcccctctcacggtacacctctatagctcttagctgttgccatcaaatatttaaccaaaatctaataaacacttgatattggagaaaaattggaatgctgatatccaagtaggaagtaagaaggtcttttaagagtttatagtgtcgaatccatttacggtccaagttaaaatttctctttgggaaagataaaataatatttataaaaattaacaagtggagagaaagtgagttgttttttggcgtcctgggaataatgaattcaacaagctgatctttggatgagtcactttagtgtctgcaatggcaatggaatatacacgtttcttttgccattcagggcttcctcagcagaaacctcacatttctttctgaaaaaaaaaacacgtcccttgatgacaccactgatgacaccttgatgactttcccacatgaggatgatttacctgaagatttggccttttctggatactcccctttttgcctttgaacaatatttatatcacatattaatcccaagaagcacaaattgccccaaagaaatctctttagagattattgactacaaaggttttggcactgtcctccctgcagaacaaaaggtgagaaaatgaacatttgccaaaaggcaaagcccaagactatgagaagcagggcagcctaggatttttctggctattgtatgtccacccaagaggtcactgctgcctccagctgggctgtgtagcttcctaggcagtgagggtcactaaccatcagtctaacaacttgtgtcaagttggagaaacattctctggcataaaatagagagtgggctgggcgcggtggctcacgcttgtaatcccagcactttgggaggccgaggcgggcggatcacgaggtcaggagatcgagaccatcctggttaatgtggtgaaaccccgtctctactaaaaatataaaaaattagccaggcgcggtggcaggtgcctgtagtcccagctacttgggaggctgaggcaggagaatggcgtgaacccgggaggaggagcttgcagtgagccgagattgagccactgcactccagcctgggcgacagagcgagactccgtctcaaaaaaaaaaaaaaaaaatacagtgtgatgtggcagttcttggaataaaattcacatatttttgactttaggtctcctttttgtttttttccattcattcatgagcatttaagctgccaccgaataggcacagaagtaagtcctgactcagtcttcaagaaaatatgtctcgttacatcatccgacactgagatgaaagctgaaaaaaaagccagtttaaaagttcaagctgggattggtggcacacacctgtaatcctagctactcagaaggctaaggcaggaggattgcatgagcccagagatttgaggttacagtgagctatgatcaagccactgcactccagccgaggcaagagagtgagaccctgtctcaaaagttataaaataaataaaataaaaataaaaattcaaaacatcctaattttgttgatgtgccctcgtatcatcagtaatgtgattaaagtccctcacatcatatattttgtacttaacatcttctacacactttaattgtattatgtcattttttttcctctgaggcaggtactattgttagctagcttattttaaaagtgaagaaaactgaggtagaaagatactaaataatctgccctaaatcaatagctagtgcatgcacggccaagctagcatttgaatatagatagtctgaccctaaacttgcatttttgatcattttgttccatcactaagccttttaaggaattcgttagtgggttatttaatctattttgcatgctacctacatcaccttcctttcaggaacaccaaaggccagttgccttttactagttaagtaatctggcatctcaatgtatcctatgcagttccataattgtgttctgtttctctcatctacttttaaatgtagggaatatgccagcttagtaagaagcgagtttgagtctagcccacatctagcacttgtatatttatttttgtcataagtgtcactgttcttaccaccatttgtcaggcaaatgtgtctattatagaaaatcaaatccagtctgacatgtatattatcatagaccaattacctaattgatatttcatattggtttacttgtttaatttatgaaatgtttacctccctgaaaacttaagtgctgggctgttagggaaaaacatgcattatgtgctccttactattatcctatctattttttcataaaaaaaaatgcttctcagtgaattcattatattcccagaaaaacaagaaacaacgcatttttttctctacttatatataaatttttacgaaaattcttttacacccccaaaagtgaggaattttaacttggactgtaaatggatttgacaccaggagctcttaaaataacttcttacttcctacttggatattagcattccaaatgtatgaccagttctaagatttagctattgcctcttttacagcgtttgacaataacattgtgcttgattaggttatgtcgtgttgtgttactgagttatgctaggaaacataataatatcatgaacaccatgactgagtatatagcatccagaaaacgatggtggaaaatgaaactggtttcagtagagatatttctctgtgccaattaataaaggcatgggaaaattagttactatagaactaaaacaaaatcactcaagaaataggaaatagcaacatgaacaattttggtattattcataactggtcctcttcaaagaagagaagcatggagagatacaaatttagaataacctcactataatgttttgagattcttaagagtattttaatactgaaagttgcatatatcatatctgggagttctgtgagacttatgcagatttggggatttgttttcttggtgtctttcaccatttctcttttgctgggcagagtactggcatttctttgccccgcaaaatgtttttgccgtaggccaaaacaaaatacataccttcaacatgggaaccgcatcgtgaaggtgaacaagtgctccaacatcttgtttactccagaaccagctttcagtgctaaaacttcttcagaaggattctcaaaggggggaaatagtatttggttgacggaaaccagaaagcagggtaaaataaatcatagagtttaaaattagacctaacgtctttgaagtgaccaataattgaaattgcttctgaggtgtgaaaagagagaaaaggtctgtctgggtgactttctagatagagaggcagtatggtctggtggttaagcgaatgcactctcgagccacaatatttgtttctttactttgtctttgtttgtttgtttgttcttgctttttgagacaaagtctgactctgtcacccaggctagagtgtggagtgcagttgtgcgatcttggctcactgcaacctctgcttcctgaatagctgggaccacaggtacatgccaccacattagactattttttatatttttagtagagacagggtttcaccatgttgcccgggctggtgtccaactcctggtctcatgtgatccgcccaccttggtgtcccaaattgctgggattacaggctggagccatggcgccttgtctagaaacacagcatctggaattaaattttatttcctttacttattacctgtttgaacccatacagatcaatcaatttctggtgtgacagcaggagcagagagagctgaacatcttggcagatgaaagcagcgggacattttcctcctgctcctgaaagagaggattgtagtagggaagttatagaagagagaaggcagacgcaagtaagaggagtaactaaagggcctttaggagccatatacccaatatttcattctaaggtgttcgagctgcatatgaatatatcagtaaggctgacacaggctcaaaatctggtagtggtgatgcaccacacctctgttgtatgtgctggtgggcggtgcatagctctctatgttggtcaaaataaggggctacattctatgttcacatgcagatacagggagagatgtaagggtggagataaatcgagaaatataaagagaggtacaaataaggattcagaggattcaggacatcagaaacagagccacttctagaaactacaaattcttgggggagagaaagcacctttacccctccgctagcaatttgtacaactttttggaaaagcattaggcttttgatggtttgaccatggagtattagtttatgttaattttgtaaattataagtggcaaggagaccccaggtaacatctggagagcagtgttttagtgtgaaccgtggaaccagagggatatggttttaatgtatccccacccaaatcccacattaaattgtagttgccataatccccacatgtcatgggagggacccagtgggaggtaattgaatcatgggggcaggttttacccatgctgttctcctgttagtgaataagtctcacaagatctaatggttttataaagggcagttcccctgcatacactgtcttgcctgccgccatgtaagacatgcctttgctcctccttcaccttccaccatgattatagggcctcctgagccatgtggagctgtgagtccattaaaactctttttctttatgaattatccagtctcaggtatttcttcatagcagtatgaaaattgactaatactcaaactctctttttcaaccttatctggacacatagaaattgggtcaactttggtcagtggccagtcatctgtgaacctcaatttcctccttcgctaaatgaaagtgacaatggtacaggtgattgtgaggattacaggtggttctgaggattcaatgagtgtacttatcagagcatctgacatataatggctattctccatatattaaaaaatgaaagaacaaagaaaaaatttaaaacattgcaatgaaataattcatacatagtaaatgggaaaaaatatatatcattattcagatttttaacaactcagctgagtgtactatgtcctactgtaagcatgcccatttttctggtgaatattttccctatctccagcttttcaggtgctgtcttcttggtcctgatcaatggaccctgggtacccatagccttccttcaagcttatgagacttggcaaaccactggcctccttctgtgtcaggggctggcactgtcaagtgcatcgtctgattgtgatcctcaggccttggcagcaaatgtacagttttcttgctttaattaggctgagattcattcctacacgtggcagctgcaaagatatattctcttacaattagatgttacaatacttgtattgcctgaaccttaattttaagtacattttggtggcccttgtccctcccttgcaccttggttgctccaagagagagcatatggcccagtaattctttaaagctcattttatgggccattctcaggcacttcctgctggcctttggaacagagccttattcgtgactgcatttttgcttatactcctgccaaatgcttcctccaaaaccagcaatcaaaccacaggacatgataagccatggccatcagaatggcttaatgagagcaacctcaacaatcaaggtcattaacagcaaccagcactgcaggatttgtatcccgtgcacaagggcagcctgggcaggtcacctttgtggtctatgagaatatctccaaatattatagaatttgagaccatctcagagaacgatctcattctaagcaattttcttttaagcaaaaatggataggacaaaaatagaaactggtggttctctctggcctctccttgtagaagaataaatctagagtttttaaaggtcttacagagcaaagaaaatattcgctggatgcttgtatggctacctaattcagtcacccttgcctcagaaaatgatctgaattaaatcttgtttccagctagcagaagggtatttgaaatacagattggatctgtacaatagaccttgttcaaagcatatccacatgagatggtacatagtttaaataaggcagacttatatcttgtctatgatctgtgtgctattaaacagttttaaaacgtgaattattaattaaaacctgtgaactactaacattttggaatgactgttttgatagctaacaggacttgtgtgacttttgagaggcgttgatttcctttcatgtcagctaatagaaatcccattgtaatcataaaaggcacagagaaattatgtcacaagcggatgctatttaagtggaagtgaacacagaatatattaaagtatcagtgttcttatcagcagtgtcttataatgacttctgattaacactgaaaagatgattgatgttcctaggattgtggagcactgacaatgtgacactgagagaattcaatccaaagcttgttaatttcatagaatcattcaatttctcattactcctttttgacagtgtttgtttttgtgaccattacaatatagtcacaatttaatggggcctttcaaaaacaatagtaagaaaaaaaccttaaaattgtcacctatgatgattattactagaaacagaaacaatgatttcaatatattaattttttttgttttaaaataaagcttattaggctgatttttattcaggagtcatatttaaactgatacaagccaaagtcatagaggactcccaagtcaaggcaatagttcacatcaacagcgccaacatatgtaggctgatttagttttttcatggccaaagaagaaaggaagcatatttgatgtaaattcctgtatgagaaacatggtaggcatgccaggtcctaaattagtataaagctaatgactgctgattgagagcaggtggagaacgggaagggggtgtagttgaggatcagtagagtttatcttaatacttttgttattaaatacttttgttattaaaagtatagaaaatataagactttctcaatttacatatcagatctggtgaatctatcttattgaactcatactttacatggattgaaaagcaatgtttacaaaaagaacactgatatgggaagtaatgtagttagcagagataaactgcggatgtttcaaataaaatcatctacctccaaaaattttactggaactagcatgtgatatttaacttgtatttttagattagtgtatctgaactttgtatcagtcagaggaaaatgtatggttggccctaaccactcagaatgtcataatcatagtaattaccactacccagtagtagtaattaccaatattctaggcttcagtcaagacactttaaattcatcattttatttaatccccataacaaccctgctaaacataggtgtgtttattggatcttttatcttcccaaatgaccacccaacgcccccacccaaatcagtttgattgaaaaatttgaaaccagcaccaaaaactttctcatctaacccagcaaaaactctgcagtccatcttttacaagcacatataagttttgttttaatttctctttccttacaaaggccgatccttccatgtgggttctcattatcacccttcaggctttacaaggaccttattttatctgtgtcctgaatcgtcagtctctttccttacttgatcattgatttcagcatagtggcctcaccctccaaaccttttggtattcttcctaaatctcatctcttactcatagccaactctaaagagttctcatgactgtgatctccatgtccttatctgctatctactatccacttctcgattcatattggctttttccccaaactctactgaaacttttcttggcaagatcacatatgaccaacattgttttgtcttttatgttcacgtattattcacctctagctttttacacacaccctctctctcatatctgtggttctctacctctaaatatggagattttcaaggttaactcctagacaactgtccaccaatttgctcgtgccaaaagtttaagagtcaccccatcaggtttacattcatacctatgacttcaaatatggtgtatatgcttataaatcccattcttagccctaagcttgttttcctgccactagatggtgccatttgggggtgatgggagacagtgacagatcatcaggcattaggttatcacaaggagtgtgcaacttggatccctcacatgcgcggttcacaatagggtttgtgttcctatgagaatctaatgccactgctgatctaacagggggcagagctcaggaggtaatgtgattgacagggagtggctgtaaataaaatgaagctttgttcgcttgcctgccactcatctcctgctgcgtggttttgggattggagatccctgttttatagtatttgtaatattgtcgcttagatagctcatggataatacaaatttaatagatccaaaatgaaattcttgaattcctctaaacaataccaataatttgttccaattagaccatagtaaggttgttaaaaaataagcaaaactaaaaaaactacaatgtgtaatctttagaagactttaaaagataaagacagatgtaagtaaagatgggtaatctctactttcacatctcccatccattcctctaagataaccaatgtgtatttttttaaaaattcattctgtaactttatgccaatctaacaggatgcttatattagttttttactgttgttttcttccacagtaggataatggtgtatcaatatttagtgactttttaaagaacatgacactaagaatgttccgagtcaaaccatttagatttgacgtattctttctaattttcaatgacatgactttctatgcatgttccaggtatgattcaacgatgtgcgctgctgtattattagattatttccaatccattttatttgtattttaaatttaaaccaaatgtattgtacgtacatagctcacgatatgctgcttgctactgtgcttgctctgaaaccttgcccattatgcactaacaacactggcttctattcagtacaacaaaacgtccctacattttttatatccagaaatttagtacggttttttcattctggaagcagttctttccctctgccttaccatcattgcatggctgtctctttctcatctgtcagatcagtgctctcttcttatcttttacagggtatcttagggtaaaaagttaaactgatgcgacagagaccccaaaacaaatgcctcaaacaagatagaaatttacttatatgtaatataatgatctaaagttgacgttccagattagctatgtttctgctccagctagtcactcaaatacccgggtgaatggtggctcttttgcattcagcaagtggctttcaagacctcccatatcattggcaatttggcaatttaggtgggtgtggtggtaggtggatcaggaacatcaaaatttgtggagatttcctctcaaacatagtaagtgaaagtttcattcatcatttttgcttgccatatttagctgcaaagaaatctgggaaatgtgatctctggttagacaagcatgtttgataacaagtctattattatgggagaaggaagaatagatcttggtagacaatttcagtctacactcaaggacacttaccacaatttgtaaatgatgtattcattttaaaaacaatcttctggtcttcccattagatagtaagcacaataaaggtaaaatacctgcctgttttattgttttattcacaaataaaccttctcccctgaatactacttctgtcttttagtaggttttctttttttttttttttttttttttttttttttgagaccgattctggctctgtctctcaggctggagtacagtggcgcaatctcggctcattgcaacctctgcctcctgggttcaagcaattctcatgcctcagcctcctgacatagctggaattacaggcgtgtgccaccatgcctggctaatttttgtaattttagtagagatggggttttgccatattggccaagctggtctcaaactcctggccacaagcaacttgcctgactcagcctcccaaagtgctgggattacaggagtgagccaccacacccagattagtaggttaattcattaaataactaattgaatgaatgaaaggattttacaggtaaagaaactgaggctcaaagaagttaaacaatttaggagaatgggtgaccattcttcaggaaggtggaaagatttatacctcagatggcttaacaagatagctagtaagcactctttcaactctgaatttctgtgattctgttatgcaggaaatcaccacattccaaataagatcatgagcctgctttgtaaaggaataaatcaagagaaaattgaaaatacactttttgtctcattggttctgtcacacagaactctttccctcacaccattacatcctaaattctcatagatgccagtcacactttaaaatggcaaccattaatctaagatgttggaagactgcagcaaacttgtgacatacctttctaaaatcacaccttccttggacagacaaagtaaatatgtgttgggcttcacagatttcctgctaggctacactgtctggaagaataaaagcaaacagatagtgagtattgtctttatcacatactgtgtttaattaaaaagaaagaaagaaacacaagattttgcaagataataataagtgcagttaaattgattgtcaactaagtcttctggtcagcaaagtatgagattaattccccttaataataaaaacattcttgagattcttctttaaaatatttattctgcaaagtaactaattataaatctgcttttctttgttttccaagatattgaagactttgaaactaaaacaagaagcacagtatctgtccgagaaggtcaaggtgtggtgcttctctgtggcccaccgccacattttggaggtatgatggggtgatttgggtcatatcatcaatgcggtcacttggagagtgatgtgagcacatcaggtcttaggctcagtgatcaccttttatcaaatcaaagaaattgtgactctcgtcaagtgcatctactgcatacaaatagttctatatctaaacattttcttttaaaaatattcgttcaagcagccacacagcaaatatgtttttaaggagatacatcatggcattgtacgtagtgtgagtgccagggctttttagagaaactgaccgcagctgtaattcggtgctgtgacaggcaaacttcatgacaaggggacaatttatttaccccactttgaggcttggttttctcatctataaaatagagacattaactgtttgtttgtttgtttgttcagttttgttgtaaatgttaaatgagctaataaatgtaaattgagtagtgtaataactaatactttagtaagtaaagaaagttaagattgttactacgtttttatttttgggctctatggagaagcaaattccaactaacactcctcttggcaatgtcacattaattaccggaagggatagatcaccattaactggaagcaaattctgtatagcaccaaatcagaatgtctcctggcaatggtaaaaatcaagcaataaatgccagcctctactttggaagactctggcttggtcagtggactggcccgttgtcagggatccaaactacttactgattctcatcctcttgggaatggattttctcaaatttcacatgatgtggtaaatttagtcgtgattctcaactcacagtgaacctgaaggaggcagtgtgaaaacatccatggagtcatttggtacaaaccaatatcacactatattatagaaagcttaataacagcaaggacttacacagcacagacccaaggactttaacatgtattagattcttaaattttcacaaaaacttataagagatatatgagtataattattgttttacaggctcagtacactatagagaaatagaaagatgttaattaactggtccaaggtcacgcagctggcaggcaatgaagccaatattcaaatccaggaagtctggttcccagaccctcagctcttaactatcactgcagttgttataattgatttccactctggaatgggagaacttttaaaatacaaaggacagatgtttaaaaataaaatttaagcaatttacttttaatgttaaaccaaatcttatttatgagccttgagaaacttgaaagcgtttttccattattatttttacacaacctcatgaattgccatgaccaaaagaaaagaaagctaattcaaagttaacaatatcttattcggtattattagagagtattatggcattatattcacctgatatgatagggaagagttgcaatgcttttaatgctatattgagataaaataatattgtttcagaacacacaataattgctgaggctcttttggtgcttattttttaacggtatagaagattattttccggcaccataatctaagatgacaaaatatgcaaaatggtatcagtttgtcctgtcagtctatgtcattttatgctcttacgatgttattcaaatattcttgacactactgaaaattgttttcaactttgtttaatcgggaataaaagaaatgtaaaatatttgtaaatgaatcagttccatatgtaaaaaaatttaaaaaattaaaaggcagccagacaggagacgcttgtccttgttaccttgtcacctatcaccattaaaggatatgtggatcttttagtgtgtgaggccctcattgtaacagcgcccgtggggtcgatgccataaaattaagtcacacatttacaaaaactgccttaaattaagacctttgtaactgaataatcttgctgcatgggagtaatggcaaacttgtgtaataccaatttttttttttttttttttttttgtgatagcatctcgctctgtctcccaggctggagtgcagtggctcgatcttggctcactgcaacctctgcctcctgggttcaagcgattctcctacctcagcctactgagtagctgggattacatttgcacacaaccacacccagctaatttctgtatttttagtagagacgggttttcgccatgttggccaggctggtctcaaactcctaacctcaggtgatctgcccacctcggcctcccaaagtgctgggattacaggcatgagtcaccgcacctggtccgagatttaatttatgttacaagtagcatctcatcatgattccaagcatatttgtcggctgaatcatgtttcttgctgttaaggtccctgtttccttgataactggctgttaagggacactctcaacttgtagaggctgctgaatttcttgccatgagcatttgtccaatgtcaaagccaggaacagagaatctgtctcacatttagtccctcgaacatttcaaatttctttagtcaggaagagccccatctcttgtgagggctcacctgatacagatcatgcccacaaaagctgaagtcagtttctttaaatcaacctgtgccatctaatcttatctaatcatggatatgatctctcatcctgctacaagtcgcactcacactcagatgaagagaattatacaagggcacgggtcgttgaaggtcatcttgggattttgccctacaatatgtttctcaaatattatttcttctatttccaatctccctaaaggctccatatttcctaccacacatggctctcacagagaaacgtcctagaaatatattcatgggggcagacggagttaacagagcactgtaaagtaaatgtcggcgtggccaaattattttttaaatctcgtgtgtaagtattaaacaaagcttctcataaagaaaagtagcacagactccacagagatagaaggccataaaagttgacttttttttttttttttttgagacggagtctccttctgttgcctaagctggagtgcagtggccccatctctgctcaccactacctccgcctcccagattcaagggattctcctgcctcagcttcccgagtagctggaaccacaggcacgtgccaccatgaacacctaatttttgtatttttagtagaggcggggtttcacttctgacctcgtgatctgcccgcctcggcctcccaaagtgctgggattacaggcgtgagccatcgggcgcagcaaaggctgaaattttacatcaaatttttgataacttagttctgttgtctttttcaacataaacagtcagcaagaatgagtctcacagggagttcggcagcaagggagaaatcatgttaaacttgatattatcagaatatcctgaattctttatgctttctttttagtgtattcacataaattatacaaaacttttttttaataaggcaggcctatcaaatatattttagtgtgatatatataggtatacacacacacacacacacacacacacataactttataggagagtaagaaaaagtatcgacatggctaaattttataaatttacccagcaaagaatggctccatgttttaaaaacaaaacagaaaagtgtctagatggtttttccatgtaaatgattggtcacaaccccatgaaacagagtaatcaacagaaaccaaataaacaggtacttttatagagctgtcctttcttctgcgtaaacgaaaggagggctgactccagcataggccttctgtggatgctttccacccagttttgaagcacagatgcaaatgtcctgctcctctagaaaggaagggttttacacggaaaggttattctagcagagaaggcatcacagtgcaaaagaaaaataacctaagcaataatgccaggacacagttcaagacgctctattttatcatttcaaaatgtggaagcagaataggcaccattctctgtaatctgagtggaggagtatatttctcttttaatcctattccccaatcagagatgggttttgtgattgtaactgaatctctgtccttaggactagactcagtccttgttcccatatttccaaaaaatcttatctgtaaaatatttccgagaaatgtaggtttcacgaagttttgtaaggacagcacagagaggactgcaatgcacatctgattacaaaacttcactaagattcctgttaaacgtctccttcattcctcctaaacgctctctcactggtaggctgtgacttcccacatctttccaacaatctccaacaattccctcgagtatctattataattcttccctatttggacacctatctcagaagaattcagtactcctttagcttctcagtgcttggcagaacgaaatttactagttggccaaacaaaaatattttatttctttcactatgtccctgcagggttctaaggtcatccctcagttcatgcaacagaaagagacaacacaaaactctttttttttgagagggagtctcgccctgttgcccaggctggagtgcagaggtgccatattggctcactgcaatctccacctccctggttcaagcgattctcctgcctcagcctcctgtgtagctgggactacaggtgcatgccaccacacccagctaattttttatatttttagtagagacagggtgggtctccaactcctggcctcatgtgatccgcctgcctcggcttcccaaagtcctgggatcaccggtgtgagccactgctcccagcccacaaaacttatttagtatttattttatttatttttggggagcaggatgttaccgtgcctttggctgaactttgagctgtatgcagagaggtctttccaccatggattctcactcacctccaaagtgagcttttgttaaatttcagtcactcgtcacaaaaaatgtcggcacaaactatctgcaacagagctgaaggcagaatttcctttaaattttggaacagatataacgcccttgaaaccaaaactgaagaaggaatatgaaaacaagcaatcaataaacttccatggacccagtgagttagtccagcctcataggaaatcttatttaaaaatgacagaatgaagcaacgatacatgttatctacaataattaaacccccccttcactatgtagtaatagtttcactttatccaaagtaaagaacactctttcccttcattggttggatatgaaactctcggcggggctcagtggctcacacctgtaatcccagcactttgggaggccaaggtgggcagatcacctgaggtcaggagttcgagaccagcctggccaacatggtgaaaccccgtctgtcctaaaaatacaaaaattagccgggtgtggtggcaggcgcctgtaatcccagctactctggggctgaggcaggagaatcacttgactctgggaggcggaggttgcagtgagccaagatcatgcctttgcactccagcctgggggacaagagtgagatttcatctcaaaaagcaaacaaacaaacaaacaaaaaagaaactaagtcccgagctcataaaaattataggtttaaaatttgatttagaggaaatgttccattctctcctcagatgcaactttcaggttggtagaacagttgaattgatgccaaaagtttggatcatctgtgtctgtagcaggaagatagcacgactgtctgagcccactgtttgtatttgcatcagtaaagatgttgacaattccacttaaattaaaagtcattccaagcaaaggctcacaattgtgttatcaaataaagaggaaaattatgtagagaaaaaagtgctaaaacttaacatccccttcctccagttggtgtgcttgctgtttctggcgtaaatgaaagtgcttttgtcttagtgggtaggtcaaattggcagtggatatgttactctgaggctctctgaaagtgtaaaaggcagacaggcccaatagttgcctcttggtataataataatagtaacgataataaccgtattattgaacttgtacactgggtattcactcaacaaatatttattatgtagttactaagtgccactcgtttttctgcattttagtgataaagtggaaaagagagacaaagtttttagctccatgaatcttataataaagaaatataaagcatgacaggtggtaataaaagccagaagaaaaataaaaggagataggaaatagtagatgttgctattgtatattctaaggtaaaagaaggtttcactgctatttgagcagagaactaaagaagtgagggagtgagacacattaagtaaaggcagttcaggtggaggaaatagcatgtcaaagaacctgtggggaaaccacgtctagcatgttgggagaacggcactgaggtcagcataggtgaattaaaatgaacagacaggagagtaaatgaggacacacagccttactttcagacattttagggactttgccttctcctgggagtaagatgaaaattcactggtttatattcagaagagtgacatgctttctctgactttcatttgtaaaaatttactctggatagtagaccacagaggggcaagaacataagcagttaaaaagtgattgtgttaattcaggtgagagagaatggtgacttggaccaggtggattgctgtagacagatagataattaccagtcttcagtatgtatttataaggtataagtaaaataatttcctgaaagattgaatgtgggttataagagaaggagaaaagtaaaagataactccaaggatttgggaccgagcaactggaaaatggagtatcatttattggggtggagttgatgaagggatagcaggtttaaggatggagtaaatcaggaatttgttttaggagatgttaatgttcagatgccagttagatacaagggtgaaagtttctagcaggcagctggattatatgtttagggcaaaagctctggtttgaagagctaaatttggaactcaccttatataagtaatatttaatactacataattggataagataatgaatacttactatgtactaggcactaaacttagcatttgcaatacttcaacgcatttaacattttccgggaagatatctcaattttacaaattgagtattgtgttaaaattgttagtgttagctaacaactatagttaactaaactcaactaactataacatagcttggccaagatcttgtctctggaattcgaaagatcctgtctaaacatcagtgcatttattccactccctaattttctctggcataatctggtccagaagagacacttaaaagtttttaaataatacaaggagataacaagagttctttactctactggagactatgtaaacaacacacagagaggtctactgatttgcctaaaattagtgtacagtgttagaaccaggaagctcatggctcttcccactcttcatagctggccaaagtcagctctctagaaagtttatttctttaagtcccatgctgcacattccttccctccactttcagactccattcactcttagaaagactattttccttgctttccagcacatcaaacagaactctcctgttgcagcctgttaccatgtgtagaagtcaggattttccaacactggtacactttgtggcagtagggccagatgttggggagataggaagtaattctttttttctctttttattatcatactttaagttctgggccacatgtgaagaaagtgcaggtttgttacataggtgtacacgtgccatggtggtttgctgcacccatcaaccggccatctacattaggtttttctcctaatgctatccctcccttagccccccaacccccagtaggccccagtgtgtgatgggcccctccctgtgtccatgtgttctcattgttcaactctcacttatgagtgaaaacctgcggtgtttggttttctgttcttgtgttagtttgctgaaaatgatggtttcgagcttcatccatgtccctgcaaaggacatgaactcatccttttttatggctgcatagtattccatggtgtatatgtgccacattttaaagaaaatgtgacagtctatcattgatagatagatagacataatatccagtctatcattgatgggcatttgtggtggttccaagtctttgctatttcaatattaaccttaaatgtaaacaggctaaatgtcccaattaaaagacacagactggcaaattggataaagagtcaaggctcctccgtgtgctgtattcagtatctcacatggagacccatctcacatgcaaagacacataggagacccacctcatgtgcaaagacacacataggctcaaaataaagggaaggaggaatatttaccaagcaaaaggaaagcagaaaaaagcaggggttgcaatcctagtcactgataaaacagactttaaaccaacaaagatcaaaagagacaaagaaggtcattacataatggtaaagggatcaatgcaacaggaagagctaactatcctaaatatatatgcacccaatacaggagcacccagattcataaagcacgttcttagagtcttacaaagaaacttagactcccacacaataatagtgggagactttaacaccccactgtcaatattagatcaacaagacagaaaattaacaacgatattcaggacttgaactcagctctgcaccaagcagatctaatagacatctacgggagtaattctttattggaagaactgctctgcacgttgttaagatgtttagtaatatccctggcttttacttactagatgccaatcgcactgcctcctccaattgtgggaaaatttgtctccagatattgccagataacttctagagggcaaaactatccttagttgaaaaccactggtacagcccatctcttacattcactgtattaagttcacccataaaagatggaaattgggaagaaaaagagaagtctagtcctcatatatttgtatcctatgacttgcttggtctccctaagaattggaggtttcctagcaattcactcagaagctggctatgagataagagtcggtaggactggctttgcaaagtacaagtcaaaaagagcccactgacaaaataagatgtggtaaagaagccagccaaaacccaccaaaaccaagatggtgaaaaaagctatctctaatcatccacactgctcattatatgctaattataatgcattaaggtgctaaaagacactcccaccagcgccatgacagtttacaaatgccatggcaacttctagaagctacccaatatggtctaaaagtgtgaggaaccttcagtcctgggaattctcctcctctttcccagaaaactaatgaatgttcctccccatgtttagcatatgagcaaggaataaccacgaaaatagccagctctgaagtagccactgttacttattcctctactttcctcataaacttgctttcactttacagtgttggctcggtcttgaatcccttcctgtgagaagccagtaactcatgtggcctcccaggctgaaccccagttttggggtttgccttgagacagctgtgttttcgttccttctccaagtaggtttggccaatgtacaaccagttctatagttatttggaacttagcaatattaggaacccatgagacctttatttaactgtcattcataggccgtaaagaaccaccatctccttgattccaaacagtagatgtgtaaatcagaagggatccaataaaatccaggtgatcaagcagtaattgtggaacgaatgggaattcaaataggagtggattttaaagtgttaggcacgtttctggattacatcgtaaacttcctcagcctaatatcaatgacttcagtccagaaaaggaattattcttcttggattaggtttttgccactgagctagcataaccatgattgaccacccaagagtcagtcacatttaaccctggagcactacacaaggtttgcagtaaagtacacacattctggaatattccaaaggggggatttacccagtaaatctgaacactatacttcaagttctttattctactcatttattttctgcctcaggaaacatgctatcaattttgagatctgttctaaagtgccaatagaagttgtcagtatcaatgtttatcatgatgcttctctttcacatgagatatttttcctctaataaaaattacatgctatataatgggtataattgcatatatctttcttgtttgtattttaaatattacagtacaagatatagggctgtaaaagatgtcaaaacataatcacactctggggaaaagaggatttgttgtatgcttgagagagcagcagatagagtcttcaattgcttactgcagatctgccatttctaataataataaaattgtagaggacgaagtcattgtgaaactacaaaaaaatgcttcaggaaggaccaattatcattcagctctaatgctactgctgactcatcacagggaaaatgcatcacaaccgttaataaccgataaatgtcatagatggtggagaaaatatttaaaaattcaatggtttcaacctaaatggctcatgaattatacatttaattaagaaaagccaaatgggaaggtttttaaacttccagtttggaaggttttttttttctttccccattgaaagatacacagattaagcacagcagtggctgatgctggaacaaaatagataaaagcccccagtgcaggctggctcttcagatgactgggaggagccagcccatggggagaagggagcagggcagggtgagaaatactatgacagcaaagacttgcagctttacatcttcaccaattcagagggcacaaaagggcacctggattgtactcccagagctgctgctagctctattcccctctgcttcttcacttgtaaaaatgaagtggttgggctggcaagtctcgcaaatccttgccatcccagacgttttatgaatgtataaactaagagacagccttttctccagactccaacacaccactcaaacgcaaatatacaaggtggtccaccattcaaaatccaggcgtttcccttcccagtgtgatgatgcagaggagactgagttttatcttttgttttgttttgtttttttgggttttttttttttttttgagacagagtctcgctctgtggcccaggctggagggcaggggcgcgatctcagctcactgcaaactccaactcccgggttcccgccattctcctgcctcagtctccccagcagctgggactacaggtgcccaacaccacgcccagctaatgttttgtgtttttggtagagacggggtttcaccgtgttagccaggatggtctcgatctcctgacctcgtgatccgcccgcctcggcctcccaaagtgctgggattgcaggcgtgagccaatgcgcccggcgagttttatcatttttatcaatgatttccaaagggtagctccagaccccccagtgtcattgtcacctaggagcttgttagcaatgcagatttcctggctcctccccagacttactgaatcacagagtctgagggtggagcccagcggcttgtggtttagcaagtctaccaaggggttctgatgcatggtgaagttttagaacctctgcttcagagaggcccatttaagagggaaaattcaagtttttatatctgttctactccctgctaatattagcaataagtactttacagtaatttcacatggcagtttaacttatttatctatgaagttcttaagaaattggacgcaggacaggaaatgttaatgggggagggaatggacagtgaggaacatttgtcttagaatgtgagtaaggttggttacttgtggagcttgggagttttgaaggaaggctaaaggtgaggaggacgagctaaggagaggacatgaacatagaaaaagaggatcaattgtaaagacattgaaaagtagaaagctattgttatgggaaaggggttcagatccggactccatgagagggttcttggatcttgtacaagaaagaattcagggcgtgcccatagattaaaatgaaagcaagtttattaggaaagtaaaggaataacagaatggctactccatagacatagcagccctgagggctgctggttttccatttttatggttatttcttaattatgtgcaaaataatcattatatacctcctggttttagaccatatagggtaactttctgatgctaccatggcatttataaattgtcgtggcgctaatgggagtgtagcagtgaggacagccagaggtcactctcattgttatcttggtgttggtgggttttagctggcttctttactgaatctgttttatcagtaaggtctttacgatctgtatcttgtgctgacctcctatctcatcctgtgacttaaaatgccttaactttctgcaaatacagcccagtaggtttcagcctcattttacacagcccgtattcaagatggagttgctctggttcaaaggcctctgacagtattattagggaaagagcaaagatctggcatctgaaggatctaggttcaagccctgctcctcccacatgttatgaatacaattttgggaaattacctttatactgttagttcttgcacccttagcctcataaagcagttgctggcatgatgaaataagtttttttctgaatttattattaatctttatgtaatcttccctatttctggattagattcttccagcagcttctaaatatctcactattaaagaaggacacaccacatgtaggaatagattggcaagttctagcagctaaggtaaaaatgaattcaccaggggagagaggaaaattacagtctcaggtcccaagattacaggttgaagaatacaaagatttcttgggcactagtggcaaactgtaatttttgttaagtgaaaggggtgacattggatttcagagagctaaagcgtatttctctccacaaataggcattgaataaggatccgtaagctgagacatggccctgggaatttgctcaagattgtctttgtttcacaaaaaggttcaaaagatgaggagtcaatgacaacaggggaatctgaactacattctttccttcctctttatattgaagaaaaatttactctctagatgactctgatttcaaacaaaaacctttgagcatctctttggtggagacagcaacaggcttagaagtgaggcagcaaaggacgtcagtaaagaaactgaagcaagagaccacatggtatgatgaaagactccaatagagacttgcaaaagaaaataaagactcaatacatgagaacagcacgagcatctcaaagcatttttcaaaaattaaaagcaaattgcatttatgcatacttgatccaaaagtatagactcttagggagatcaaaggaatgttgaggctgaaggaaaccattcgtagaagcttaggtttaacccccatccatcgtcaaaacaatttttttttgctacatcccgagtagtgttcatccatactctgcttgatcatgtctaatgataaagaactcactacctagtagatcatccactgctatccttctcaaatttagactgttcttcattatattaaatctaacagcattctgtcacctccagcagccacgagtcctacttttgccttctggacattgatagagagggttttatttaactttttatgcgtgtggcagctcttcaatgtaaacagacagctgtaatatgcttccagaatctttttttccagaggcaaaatcaaagttttatcactatgttttgtgactggcttttgctacattttattttttatctcttgataaacttgatatttttaattcctctttcaataatgggtgctccgaacaaaatatttcagtcaattgcatgcgtcatttggagggtgtcgaaaacacagatcccatgatacctggctcagatagaataaataaaactaaattgctaagaattgagttagctatttgtattttaacaagcttctttagtgattctaatgtacatcaggtgtgggaatcagtgcctgcataaaacataaaacatccatttgaacggttcagagtaagaataagaaatgttatccaccctgtttttacaagttgcagctcattctagtgtttagcctttctgacactcttcttatcctgttgattctttcttccatttacacaaaaaatgcatagcaatttaaaattataatacgacagaaacacattacaaagagagtaaaagccttttgtatttccctccactcactctgagaaaaccactgtatacatctccaggtttttaaatgtaagaatttgcataaacatatcacacacacacacacacaaagttcccacactcataacatgctttttacctaacaatgctgcttaggttttttttcccacatgacactacttttatggtttaatgacactttttgcattttctcacttcatgcgcaagtagcatttactgtgctcctgctgttcctggtctcatctttactttatttcttctccattcctgggaacgatatcagggttctgtctgcagagacaaatttctttttactgacatcatttataaattgttgtgagaaattaattattttgctcctccccactattaatagattaactttttccttctttctctttccttccttccacattttctttctccttttttcctttatttcttccttcctaaaatctcattcctttaagtatggttcatgcttcatgcattttttttttctcgatggaagggatgacaaaatgacaatattccctcattcccattttcaagagtttgtctctatagatcagatttaagtccaaaatagctgtcagtttgttttgccaccttttacttttgggaatttaaatttagtaaggttagtgaagaatgtttcaggtggtctcttcccagctgaggaagcctaccggaacatatcagaaataattagcttcttttgtctctgccatgtcttgcttccgtgccagtttttaatgtaagtacagttggcaaatagcaactcagctctctgtttggacaagaggctccaagatgcataaactactcccctgtgaactataattcaaaagtgtatgagggtccatccaactgaagactttttttgagttagttgcagtatattccccttctccaccctgagtacctatatactccacctattttggggatctcctttggaccagctatattcttctacttccctagacatagttctactctacctagtttccgcagtacacctaatgtcttagcttcaggaagaattatattcaccaagctttaatacatatgaatatttgcttttgctcaaagatttctggctaaaacgaaagaaattgacagcacatgatttttgtgaggttatgggacaactggaactctcaaatattgctggtggaagtataaactgatacaaccactttaaaaaattcttttgtcatttcttataaagttacacttacatctacattatggcttactcctaggaatctaaccaagaaaaataaaaatgtatacagacagtcttagacaaggatgcttatttccacctaatacataatgacctcaatctggaaataatccaaatgctcatcaacaggaaggtgtccaatcaaattatggtatattcataaaatgaaatactatccacaatataatggaagaaagggcttatagtcatgaaaacaataggtgaaccttaaaattatgttaaatgaaagaattcagacataaaatagtacattctgtttgttttatgatgacatacaaatgacagcagaaataatctatgatgatagaaatccagtagtggttgcagcagtagaaaaaaacaggggaggatttctgaagacctggaaatcttcctcattttacttggggaaggatggttacagggggtatataatggtcacaagtgattaaacggaacacaagttctgtgcattttaacatatgctcattatgtcatttatacagttacccacaagatttccagagatggactgattgatgttcagtaaaaacaatgtgtgccctgtttcatgtttatgctcttgatagttactcggagaaatgcttgtcgactcctccgtcacttggatagctctagtttatcgtgccggtttcaaaatggaattccttcttagaagtcttttctgatgacacatcattctaggctccttctctgggctccctataatgcctttgtcaaagcatatgttatccttcattgagattactcacattattggcaattagcagtaactggtgtgacctttatagggcacaggttttgtttggttttacactaagacctaaaactgtcacagaatagctgcttaaaattatgtaataatcaggccagtgcagtggctcatgcctgtaatcctagcactttgggaggctaaggcaggagaatgacttgagctcaggagttggagaccagctggggcaacatagtgagaccccatctctttaaaaataaaaaagaaattatgtaatgatcaaatgagtgaacttcaaggtctgtggtagacttcttgaactgaaatttttaagttaaatttttaacaagtacctgtaagtatgtttaattcttctgataatgcactgagaaacactgctttgaagcagcataagtttttcctaaggaattcagtgtacatttggaacagttattattttatacgtcttatggtatttcttaataaactcatccacttatttccataacatcctattgttatatccttaatcccaaaaagtcaatgatggggaaagtgcccacataatttatcgtccaatctgagctatatttcaatataagggaatattacaattacaccagatgacagctatcaactgagcaaatagaggcacaattttctcctaattatggggaagtaagacaaagaattttcagatatgaatgaatgcagtaaggacagtatggttttgttttgttttgttttgtttcttgtttttcagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtaagataatgagttatcttgggaatgtactttatctttggcccttaaagcctgggaagattcgtaaagctttctgcttccttcttgtttggtggagccaaattacgagtttaggttcaattcacaaatatgtaaaccagaaatataacagaaaattatctaattcacccacatggtgcagtagacatggttctgggtataccaagccatctcctttctggcattgaaacagcttgtcttttttttgcttaaagactgttttgtaaaaacaaaaacgatgttccggggagttggcgtgtgtgtatgtgtgcacgtgtgggtgctgccaaacatataactgaatcaatatatttttaatgaacatatgttgcagctactttttaatggccccttttttccatatttgccctttttttgttgttcaccctttatttacgtggctggcaaaatggagggaaaagttcatatccaaggaaagcaaagcaaaccaacattaattatgagcattccagagaagaatgaaacacaagatttatactaattatattcctccaaggaacataattcacactagtctctgacgagctttgtagcttagtcaagtcatggctggtacaagatttagagagccagaaagtttaaggaagtcattgaagtggagaaattctctagttgtttttttaattaaatgttcacagtgggattcatacaggtagaaaatttgttggtgcattttatgattgtattcaggacttgaaatgcaatacctcgtggagtttttctcccctctgaagagttgaagaaaagcaagaatataatgctaatgaagcataacagaattgtggaacaagtcccatagaaggagttcttataatagagcttttataatcactaaccacccaaatgtatttgcaaggtcttcactaagatttcagcaaccattagacttattcctaagtccaatttatctccttcaatgaatactactatttatgaccagaagaattcatgagccaacaatatacttggagattctaccatgtttttcctttttttgtttcctgtctactctgagtttctgcttcttgccttcttaattccttccttcttctatcccctctattcccttgaatacatttacaggaaaaatagagcagaagtattatatataatataaaaatcaaacctattttaaaagtgagcaggtaggaaatatcagatgtcaagaaagtgaaaaagaataaaacctaccaacttagttgaatgaagtagtactcactaccttctcaccataacctctttgaatgtttataatgatcaagtcttaaaaattaagtatttttatttcatatatattttgtaatttttactttttctgcaattatattgaccaccaacaatgtatttattttagaaatgtattactctgtcgtttggtacatagattaaaaatgatcaaagtatttaaataatcttgagatgtcactgattaaattaattaagttaatgagaatagcctacagatatatttctgttacaactcctctggtaggcagtgtatttacaataggttataccatcatcttatcttggcacatatccccaattccttggattgaaagttttaaaacttaaaacaaattcgtataggtatacagcaaacttagcggcaaaaccttattgtactaatatgtgaatatttacatttttatctcaattaatgtgatgcctttatatgttctgctgcagaactactgttattttggactaagacctactgcagtggacttctaccagtgttagctgaaaacatcccgttgttgttgtttttttctttttttttttttttattaatcagatctggctctctgagttccctgaaaggtagataaatgtggatgtcactagaaaagtgtcttttttgaaaacacagaagcattttagaatctatatgtatccaattcttaactgaaaaccctaactcttattaagaagaaataatcaggttttggttaatgaagcatttacttcatagaaaacttctattctccagaaatgctgctagctcttttgatatttaacaggtgtgatgggggaatatgaaccaaagattgaagtgcgttttcctgaaactatacaagctgcaaaggattcatctgtaaaactggaatgttttgcccttggaaagtaaggtttttgtttttgtttttgttttcctggttgcattaatttttttttattaaaaacctttttgttattcatatattgctctaaggtaaattaccaagtagatttcaaatgctgggcaacagtggaactttctgatttgaatttaaacaaacatgtctaatactgagacaatgaccaggcctgtaactgaaaatgatcagggctgcaattcttccctacaggtgctgatatttccttagtttaagcataatgagacccatttaggcagcacattgcaagggaataagtgcactcgtataagatgatgggcaagtcactaaaccttccacatatccttcactccatcttgtcctacatccagaaatacattgcctggagtatttccttgcttaattaaccaacaattctgataaataaaaaaccactgcttgtttccaaaataagactaattaaagtccattgttcatagtgggtaattagaattgagcccaaccttccctgatagtggaggcattttgttttactcagataagtatttattaggaacaggtttggaatacttttaagccaggaaaatacctacatttttgcatgggatatctagaacccctctttgctttttggaggtatacaaatttcatttttgtgcctataaacaccagaaaaaaagaaggagacagatagactagactgtcattttcaaatgttaatatgcatgtgagttacctggggacatggttaaattcatattctgactctagaggtctagggtgatgtttgattcctccatttctaaaaagctcccatatattagtcatgcttcttgtaaacagaacatactttgaatagtaaaagacttgactgactcagaggtaagctcggagggcttacctctaaatccaaagtctattcctaatgtggccctcacatttagaaatagtgacttagtctccaaattctagaaaacatccttaaatgtctcagtcatattattaagttaaacatactcagcaatccaaataatggtggttactaaatcttagtttgttttctatagatggagttttgcatatctttgaatgaaatttctcagaatagtcatttctcatggatttaagagaccgtattttattttcatagagtatgggtctcatagcatttatcaaataaataattattgattgattaaatgattcttaagaaagtgacaaataggggctttacatcagtttttaattgtctgccttttaagacataatgaactttcaccattttcaggctttttcagaagttaaggtttataaaaatattaaatgtcatcaaattctttgataattagataattaattttaaaagaaaaccaatgaaagagagtatctgaaaagaatattaatagcttatttaatcatatttggcatcaggaaatatagattcctgaaattaaaaaatggtcttccacaataaaataattgaaaatgttgaggctatttctcaagaatctaatgaaaataatttcatttgctaagcacctataactaagcatttatgatacaatatatataattgtcataatcttgcagggcaagttacgttttcattacatatgagaaactgaagctcagattggagaagtaacctgttcaatcttatgtttctattcagaggaagcaagcaattcaaacccaggcccacctgattttaaattctgaatttaggaacttctaagtaaatagtaagagaactgcttttgaaatcctgggagacagattcaattcccaattttctgaagagttatttgattgttagcaaacgtgcttataatctctatgaattaccatattttcatctgaaaggagttatgatgattccaccttgtatgtttgttgtgaagattagaatggataatacatgttaaaacattaagacttggcatttatgtaataaatgctcactgaattattctaaaaccaaaatccaaatttcattctacttttttttttgagacggagtcttgctctgttgctcaggctggagtgcagtggcttgatctcagctcactgcaagctctgccacccgggttcccgccattctcctgcctcagcctcccaagtagctgggactacaggtgcccgccaccacgctaagctaattgtaatttttttttggtatttttagtagagatggggtttcagcacgttagccaggatggtctcgatctgctgacctcgtgatccgcccgactcagccttcctaagtgctgggatgacaggcgtgagccactgcgccgaccgcattctgcttttatataagcaatgtttgaattagtgaggatgcccaagggagagtaggtgtctcagagggggtatgaattctcatctttcccagcccagtcctgttctctctgtctcaggattgatgacagtataagagagaaaggagcaattagggtcagttcaggaaggaaggaaggaaggaaggaaggaaggaaggaaggaaggaaaaagaaaagaaagagaaagaaagaaagaaagataaagaaagagagagaaagaaagagaaagaaaaagaaagaaagaaagaaagaaagaaagaaagaaagaaagaaagaaagagagaaagaaaggaagaaaaggagagataacatgatcaatatagtctttgaactgctcacataccagtttcttaaatttatttatttttatattattcaaacctatagaaaagttgaaagagtaacacacggacatcatatactctatctgaattgaccaagtgtaaacctgtgctacattccctttctctctctctctccccctctctctctttctttctccacacacaaatatatttaaccagatacatggtaagatctaatcaggaaaaatgaagcttgggatatatgaggtatgtggaataatttaaaaataaataaagcagtgtcttattttctattaactccatggtgatggaaataatcaacgtattattaaattgcaaaaggtaaaatttataatacaggagtccctaaacttttttttttttttttttttttttttttttgagacggagtctaactctgtcgcccaggctggagtgcaatggcacgatctcggctcactgcaacctccgcgtccccggttcaagtgattctcctgcctcagcctccagagtagctggaattacaggcacctgccaccacacccagctaatttttgtatttatagtagaggcggagtttcactgtgttggccaggcttgtctctaactcctgacctcctgctccacccatcttggcctcccaaagtgctggtattacaagcgtgagccactgtgcccggctcctaaacttttgacaaaaattaaactagcaatatttgacccagaaaaatttgagttggaaaattaatagtttaaaaaactctcaaaatgtaaaatctgatgtgtatgtacaaaagaaaccccctgataaataaatcatgttggttaagtttatgcaggaaataaccgttgaacatgaaataatgttaaatgggaataggaaaataatataaattaccaaaccatacctcatagaaaattgtcaaggaaattcttgatttaatagagtacactccctaaattgttatctaacaaaattaatcaatgttgagattatgtttattaaatgaaggcattaatatagaattgaaataccttgtggtaaaaatggaaagtctgaagcatctgctcggtcaaagcggtagcgttaagatgccctgtataacaatcttacattttgtgtagttggagtgcagatacatttctcatttcttcaaaacaacgaaatgtatgtgaaaatactttgactactttggaaaacttacaaatgtgagttactaccaaaaagaattttatatatgcttgccaatagttttcagaaaacaaattaaattatctttgacacattgcaaacatactgaaaatgcctttgagtccattataaattaaggtatttagcaaatgccatattgtcttctaaatatataaaattaacaagcataaaaggcgacacactcactagaagattaattatgttataggtatataattaacaatctgaaaataaaaagtcaaacgtcttatcttcaaaattataaatctgtatttgtaagtttgttgccaagtgtttttataaagtctattgtttattataaatcatattctctaacatctcttcataaaaatattgctgtgcagcatttggttttagtcatttttttccccaaatgtggggactcccttttactaatccttctaaatcttcctgtctactttgtgatgtactttactcttttgtaagatgttgcataacctcaaaactgagaaaagctagttgacttgaggaataaaatcaaatatttttttcttattacattactattcattgactgctatttaagctatagactacacatttattagactaagatgtatatattttaatagatgggggaaagagagagagaagagggaggaaggaaatcaataggtgggtagaaggaaaaagaaatgaaaatatagaaagaccagctccagtgccagatcttattacattttttatttttaggtcataagagagcttctgatataaaaattggcttttgttaaatgtttgtttaatgtaccccatacatgtgctcacataactaggaaatatcaccccctatcactgggaatattttttctcttgaggttgtagattatttttgttatttatttatcttgctttgttttctctgaaattcctgagtctatggtttggtgtttgtcattatttttgaaaactattcaggcatgattacttcaaacatttatttgtttgtttttttctccttttagtatttgttttacattatcttttatgccatttgtaatctcccttctgtccaagttcttaatctttttaaaatttttatttttatctttgcatctcagtttgggaggttctattgatactgcttgtcattcatttacttccccccttagctatgttcagtctactggtgagcccatcaaagccatccctcatttgtgttataacttattttatttccagcatttccttttgatcctttcttagagttttcttctctgtgcttacattatccatttgttcttgtatgctgttcacttttttattatagcacttaatatattaattatagtaattcaaaattacagtctgataactgttcaattttaaatcctcagcctgatagtcctaaaagtttcattgtatttgagtctagttatcatggttgttttgtctcttcagactgttttttagcaggctttgcacttttttttgaatcctggtcattattatatcagattaaaggaacttcaataactaaacttttagcgtgaggttttatgtttttctagctagggttagactgtaattactgttggctctagctgtggtatcagaggttaaattttagctagtacctttgcttttatctccactcttgcccttgggtttccctagagactctttcctaaatagcatctaaagcttgccgttatttcagctgtaattctctgcactgtaattatataggagccctaaataagtcctcgcttgctaattctatcatctcagttatttgtgggtctgtttctattggctgctttttctcctagtcacagttctcatttttttgcttgtttggatatctagtaatttaagattgaatagtagacaccataaatgtcttgttgttgaatgctaaattgtggtgtatttattaaaaagctttttgaactttattttgataggcagttgttatactactgtgaatcctcgagttttctgtggttattaaggctggtttactactaaaatgaaatccccaactgaatgcttcaaatgttcaccaagtttttcttctctggcatagtggagctctcatgtcttccaggcctatttgagctctgaaaattattctttgcccagcctcatgtgacactcctatgcagatcttcagagcacattatttgagtaatgccattctttctaacactgtgctctgcaattccagccacttcagcctctccaaatcttatctttgtcttctcagcttagtgacacagtactttactacttatgtctcccctacctactccctgatctggatggaaagcatctctacacagaaaataagggctaccaaaaccttacttcatttatttcccctctttcaggatcatacttttgtgttgccaattgttcaagttccagaaagaggttttttttttccatatatttgtctagtttttcactgtttttgaaatactaattacggaggtaaatacagtgaggcttagataaattaagtgacttaaccaatgtaagttgcataagttgcatatctgggattcaaatctacatctcatagattctgacttcaaaactcatgcttataacactttcatatttatattgaattaacttctaagtatctgacttacttaatcctccatgtgcagatgtagtatgaccctcaattatgtaaatattttacaagaaaaaggcttgaaagaattcagcaaaatgttaaaaaatgctttatctagggaatggaattatagatatatttcccatttatattatctataataactaatattccagcaacaagtaagttttaattttatatattaaaaataacccttggccgggcgcagtggctcacgcctgtaatcccagcactttgggaggccgaggtgggtggatcacgaggtcaggagttcaagaccagcctggccaagaaggtgaaacccccttatctacaaaaaatacaaaaaattagccgggtgcagtggcagacacctgtaatcccagctcgggaggctgaggcaggagaattgcttgaactcagagggtggaagttgcagtgagctgagatcgtgctgctgcactccagcctaaagacagaatgagactctgtcaaaaaaaaaaaaaaaaacaaaattcaaaagataaacttgtaaaaattcaagctgtgttttaatgagaagaaaaaagtgttttcaaaaacatcaaaaatcaggtttatacaccttattattttatagatgatgatggcaatgtacaccatttctaaaagtctggtatacctgattaggtagcactcagaaaacatagcttctgtcacggataccatcatgcagacagaatgtataaaaagtgaggtctagagaagaacaggtgaagtgtttactcatataatctaacaatcttaaaccactataagctagtgtgagtatagaataattaagacaaagcttcaagtaattgtcttaactttaattgctatgactttggggatatgtaactgacttcctttgttggagtttcagagctgacatgatcacagctttcaactctcagctttgtctcatttgtttaacatggtggactcttaattatgaaagctgcaaattaattgtattgtgaaataccctgagaagctccttgtataggtgctatgcaaatgtagtatgattgactgatagatatgtacgtctcctttgaaaaaaatatgggctcttgctgagtgaagaaattaaactgatatcccccataactctattctactgcttttataaacaaccaaacatattttcctttttttaaaaaaatcttaatttagtaccttttctgtcagtgttctggaatgtaaataacattagtagcagcactgaacgttcctgtgtgttctgaagccttcacacagaggactatatttatgtgtacatgtataacttatttttttttctaatttatgaagctaaagatacccagcttggctattaatgtcaagcaacaaatctgaagtctcaccatgatgttgttaggtgttccagaattttcaggtgacagaggagctatttcttatagtgtttgcttttcgtcttactaatgtggacatcattgcagattatactgcagaaagatttttcaagtcacttaagatgaaaataacatttttaaatcaagctaggcacactgaaatttttcagttccttagcgattatttttggtttattgaattaatcactcaggtatcttaatgattttgaaactggatgtctaaaaaattgtttaccttttgtttcccctcattgagttgagcagatagagaacagaatctcttcctaggcatagtttaccccattcactccagaaatgtatactgaaacctaatctttagattcttgctaatggctttttctataacacgatattatcaataacttttttttaacatgacgtggtattgcttggcataaaataatcaagtaaactctatagaacactcacctctgttgaccatgctcacaaatctgagaactaaaaaatcttcaagccaattattcagaaattgaaagataacattaaacccactacactctcacataaacaagcgctcaacctagcaataaataatttatcagtgaatttactagcatttgaaggcaaatggtatgctgaaaagtgtggactttaagttcaaatagagcaggattggagtcttaacttcacttgtcaatagctggatgactttggtcagttttcttatctgtataaggaaggcaaaaatgatagagagagaataaatagatacagcagaatgtttgtaaggactggaaatactattaagctcacttactaaatttcctgacccataataggcattaaatagtaactactttattaatcctgggaattgtcaaagctgctttgactgaggaggtaaaaaggaacatgtaagaaggagcgaagtggtttctgtattatatttttgtgttaagggacttccccagaagaatagatttatcattttaaattctgttcaatctttctaagagttactgacgtttcctcactcactcatttgacaaattgagcacaaattattcattcacttagcaaatatgtattgaatacctcattccatcattaattccttcatttcttcatttaggtagtcagtcaggagggattctccaaaggacagacacttggccctgggagataaagaagattacataaaggccccggggaggttgcaggctaatgaaaataagattgatgtaacaatgtgcaatcacacattctcttgggatcagctctttccttccagactttcagtgaaggaagagtcaaggatcctcactttgggagctttactgattatctttttcccacgctgccctttatcaaatagagactggagagggtcactgtcatttctttagcagagctaattttaggctattatttaagggtttcttgtatttctgagaaatggaaaattatttcttccttttttcccctctgttcataaatacattttttaactaatggattttaaagaatagttttagaacagaaatattgaacggatagtacagagaggtccaatataacccccccacacacaatttcccttgttactaacatcttacgttattatgatgcatttgttacaattaaccagccaatactgatgtctgattattataaagtccatattttattcaaatttatttggtatttatgcccttctattccaagattccatccagaataccatattacatcgagttttcttgtctcattagtcttctcttgtctgtagcagaatctcagacatttcttgtgtttgatgtccctgacagttttgaggggtggtggtcagtttattgtaggctgcccctctgttagaatgtgtctgtatttgtcataattagactggggttacaagttttggagaggaagaacataaaggtaaggaacaattttcattacatatcaaggttaactttatcataatgatttatgacagatgatgctggccttgattacctggctgaaatactttttatcagggttctccactgtaaaattactcttttctcccactccatactgactctttggaaatgggtgactatgtgtagtccacatttgatgaatagagtgttgtgcttcaccttctgcagaataatgagactatagaattcttctacctgtgaaatgtgtcacttcttcctcatttattaatatttaataatttacttctgtcagtactgactcacatataattattttagactttgggttgtaattctgtgctactttgtttattttgctgctcaaattgttttagcttttgccattgggagacttttaagttggatcttgtgccctttgttatgcactcatcaatgtatggggtgttttgtgtgtgtgtgtgtgtgtgtgtgtgtgtgtgtgtgcacctgttagcactttcttatttactggcattaaagatgttccaggttcatcttgtatgtttcatgccctagtcatagaagcagtcatgtctccaaggatagggtcttgttattgaagaatgacatcagaaaccaatatctgggtactaggtgtgcttgttgctgctggagtgtcatttatttaggcgctctcagatgacagagaaaagaagtatgtgtgtctatactaattattatgtacatatatctataagtatttctacatacagctatttgtattatgttaaattaaacatatgatcttgttgttgtctccgactctaatccattaccacatggatcactctgctctcctccacttactgatcagtacctttccactccacacagtgctgtcccattttgcaataccaccagtaataaattagaattttgatttctcttaatctacaccagcatttgatattgtgtgtgtttttgttttgttttgttttttagccattcttacaggtgtatagtggtatttccttgttgttttaattggtaattctctaacggcaaaggatgtgaacatcttttaatgtgattatttgctatctatttatcttctttagtaagacgtctgcttatatcttttctacatttttaattggtatgtttattttcttattgatgagctttaagaattctttgcatattttgaacataagccttttatcagatatgcgttttgccaatattttctcccagtctgtgacttgtctttgcatttccttaacaatgtccttaacaaagcacaaggtttttattttaatgatgtgcaggttatcaattttttttccaataaacggtgtttttggcattaaatacaaaaactcatcactatatccaaggttacctagatattctcctctgtcatcttctagagctattatagctttatgttttgcattttcattgatggtccattttgcattaatttttgtgaaagatatgacttctgggtctattcattttataacatatggacttccaatcgttccagtatctgttaaaaagacaaatttttctccactgtattgcgtttgctcctttgtcaaagatatgctgactgtatttgtataggtctattaccgggatctcttttgttccattgctctgtctattcttttgccattaccacattgcctcaattactgtagctttacggtaaatcctgaagtcaggtaatgtcagtactccaactttattcttcttcttcagcattgtgttggctattttgttttgttttgctttccttgtctttccatacaaacttagaatcattttgtctatatccatgaaatagcaattggggttttgattgggattgacttaaatctattgatcaagttgggaagacttgacacactgacagtgttgagtcttttcatccatgaacacagactatttctccgcttatttcgatctcttttaattgattttatgagattgtatagttttctgcatgtaaattctgaaatactattttatataaaccctagaatttcatgttttagtgctaatataaatggcattgtatgttaattgtggaattcaaattccatttgttaactactggtataaacaaaagttaactgactttgatatattaacattgtatcttgttgccttgctataagcacttattagtgctggagttattttttgttaattcttggggatttttcattgctgcctgggaacaagtattatttccttcttttcaatctatatacattttttttgccttttcttgtattattgcaccagctaggatttccaatacaatgatgacagtgagtgataagagtaaacatgcttgcctttttccgctatccaaaatgaaagcatccaatttctcaccattaagtaggatgctagtgctacattttttggcagacatttttatcaagttggggagcttcctctccattcctagttcattgagaatttttattttggataggtgttgcatttttccaaatgctttttttggcaccagttgatatgatcatgtgatttttcttctattcattagtggatttcatgaattaattttctaatattgaaccatcagtcctgcatacccaagacaagtcctattttgttgtggtgcataagtctttttaattgttgctggacacaatttgctaatatttgttgaggatttttccatttgtattaatgaaagatactggtctgcagttttactttcttgaaatgtctttatcttattttggcattatggtaatttggcctcatagagtgaatttaaaaatattctctctgcttccattttctagaagagattatgtacataaagaagaaatgtatgtacatcaagaaaaaatagaggccaggcgcagtggctcatgcctgtaatcccaggactttgggaggctgaggcgggcagatcgcctgaggtcaggagtttgagactagcctgcccaatatggagaaaccccatctctactaaaaatacaaaatcagctgggtgtggtggtgcacacctgtaatcccagctactcaggtggctgaagcaggagaatcgcttgaacccgggaggcagaagttgctgtgagctgagattgtgccattgcagttcccaaaggacaaaaacgagcaggagaaccagagttctagaagtgaatttgaaatgagagctgagggcaggcaaggaaacaagcaaggagattaggaagagttacttcctttgcttaaagcaaaacaaatacatacttaggtttttatatatacataggtgtatgtatatataaaatgtctttatatatacataggtgtatatataaaatgtctttatatatataggtgttgtatatataaaatgtctttatatgtacatatatgtgtatatatacacatatatatttgtatatgtgtatatatacatacatatttatatatacatatacgtatatgtacatataaaatgtatatatacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaatgtctatgtgtatataaaatatctttatatacacatatatgtatatataaagtttgaaaaagtcagatatactcatttaagaaaattctgaaaatataggcaagaaaaaaggagacaataaaatcctttttatacttaatttctcccccaaaggataactactcttatttcagtatacatatatccttcctgtctttattctacttttaacataattagtataatacactgcatatttgtttgtaaatttttttaattcttaaaaatataccatgaacatatatgcaagtcattaaacagtcctctgcaccctcatttgtaatgacaatgagatatttcaatatatatttatagccaatctcctattggtggacatttagtttccatcaattttgtttccaattttttgtaatcatgaataataatgtaatgaatattcttgtggctgtattttgcttacgttcatgtaaacttcctaagtatatttttagaaaattaggattattggtaaatggaacactatgtaaaatactacgatttctaaatatcttgccagtttctcaagaaagattatagaggggccactgtcaaagaccagggacctgccctaaaagttggcctcttttaatcttaaagacacactccgaatctaatgtcaaacattcctttccatatagtttttgaaaatttttttttcaaggagcatagagtggattgttacagtgctgtttctaaaattaaactaatttaaaggttcttaaaaatcatccaagaagaatatatatatatgtatatgtatatttctggaagcaactcatcatcctttccatcccagtctatcaccacctctctcaggagacccacagttcttacttttaagtaattggcagtttacagtagagaaggatttcaaatctaagttggaactgggctcaggaaaaataataagttgtttgtttcctattttccagctgaccttggagcccatctctaagcttctactcaaatttggaggcatctcaatatgttttaaaaagatagtctccgtgatttcaccttttgcctcttatacaaaaaaaaaaaaaaaagcatctattgactggttgcaagacacattagttccttaggtgaagaatgtattgctaagcacatgttatacaccctaataaggtttgctctcattttgtacctggttaattcatgcagggggagcaaagcatggtgatttagagctccatgtctgtggaaagacagactttggttcaaatccttttttttttttttttaatttactgtatgatgttgggcatattacccaaactatcctaatcccaatttgttcatctacaaaatgtgaacaactgtaatcgtatgtttgatagtgctatagcatgatttaaagaaaatacttagcatggagctaacatataatatgtgctcaattcatgttaaataatgataaaatgataaactgttaatatgccatttcagtctctttacttctttatatgaaaatttatgattccaaactgagacaagatcaaacggaataaatttgaggtaacacaaggcccacctacctataccaaattatcattttctctcctaagagcagcagaggtatttatcgaggcttagtattatttattaataaaaaattatagacaagctgttagtgaactgctaagtgcagtatcatattcagctctaccacatcttgaaatagtgggcttcaattcatgtttcatgtgcagattagtattcatattatttacattaaaaggagtagaaattggtagtaaaattcttagagaatctttggacaatggtcctttcatgtctctgttcataatcttggtattaaggcaatttactaagccttatttatgcttcaaacattgtattttagaatgtactctcatggatatttcctcatttgctcttcctgtgtactcattcttatttctagttaatgtaaagagaacactgagtctcagagaggttaggtaacttgtattcagctctataaaatttgcctgcgtccttttttttcccccaactgcaggtgccattctgttaccactgctattataaacaaaccatttgtggcttttcaaagatgtcctccccaagggaaagctgatataggcatcatcttattcccattgggctgccatcacaaaatactgtagacttgtaaacaacaggaattggcttgtgaacaacagaaatttgttgttcacaagttctggaggctgggaagtccatgatcaaggcaacagcagacttagtgtttggtgagatgtctggtgagggctgatctctggttcatctagctgtgtcctcgcatggtggaagagaaaaacaagctccctccgatctattttataagaacactaatcccactatgaaggctctatcttcatgtcatagtcccacctcctaatactatcaccttaggggttaggtttccaacctataaatttggggaggacacaaacattcatttcctagtagggactgactgcaaggacagaatcatgactccatttacaccactcagagtaaaataaaaatgttttctctttttccgtaacagtgagattgcttttctacagaactcatgaatttatccatattgtattgccataggacaatcttacattccaagctctttgtatgaatatttcaaattggggaaatgaaagcagctagctgaacagtctgaaaatgtagcaaaggcattctttgctggttttgttattctgcttcactctctttgattaaaactggcccactgacaggatttcctgaaatgaggttcaagttaataatcccaaatacaagcatcttaagaaactcattctctgtaccagtctttagttaaaaacttagtatggcttggatttaagctgtagataatgaggtttaagaaatccaggggagaaatacaagctttctcaaatagcactagtaataaaaattctatttatgggctaaaggtatagaattgaggcacagtgtgcttctactagtgtatgtagagctttaatttaactcgaaatcaggatgaactaggtcagatggttaagaagtgtattctctgtcttcagataaaattaataggatgctccctttgtaaaagcataaagacatgacaggatgaagtaaaagtccatatttatggcaatgcgtattccagaagcacgaaaccacagcagaggaaaagaaaaaagaaaaactttgcttttatcatctagtagtatttcacaattgtgaagaatcacatttcaggcaaccttcatttagaaaataggaacaaaataagaaaaggcttttgcaatgctccttttgaaatacaaggttcaagaatccctcatctatggtctgaggaatctttgaataagagaattgcttcatattggttttctttattgagatttgcatccaagctcaatttttgtaaaaagagagaggggagaagtgtaaaattggagtttaaagggaaatgttgccagaaacgactgatatctgtagttaaaatgataatggcaccatttgttttgactctgtaacatcagtttcaagagatttaacgataatctccattctgaagaccccttcaaagatccaccttcctccatggtgttctttatctgattaatatattaacttttcattttaaagagatcatttatcttgaagcaaaacgaactcctagtaaatactgcattgctagtatcaacatggacaaactacacagagtctaaaaagaatgctgaagccacagtaggagaaacagtctattagtgcttttaatttagtgggtggcaactcaaaggaattagaaggtagatcacaataaattagcgtgctctggaactctaagtggaggagaactggcaggtaataatttagttgaaattacccatctaaaggtgagtatcattccaaaaagttaattagcattgttagcagctgcaagctgggtatttagctcagatggcatatggaagccatctgtcacaatgcctggtacatagtaagcactcagttaatgattattaatattattttaaaatatctaattttcctataccatttccttcagtttggagagcactgtctgattgctttcttccctactgaaatggtactagatgattaaccacgttaaagaaaaaggtcctccacacccacacatccatgtctcacctgaaagattcctgcccttgtcatgatgaagtgaacatgactactatgatcaaggttgtatctccatagcagctaggacattaaatggtgagatgcaggaaatttacacacactcatgcttgtgtagccgtttcattcatagtgtggagatctgatttcagtgtataaatgattcgtaaatcagtttgtatcaaatgcgtagtcatatggatcccttaacagagagtaaaagacaaatacatgtgaattaggattcctggttttgaaatgatagtaatcacattataataatcttaaaatatttttattaattgaacactcaaacatattgtttaataggtgctaggcagtatggtaagcatgtgacatgaattatcttaatcctcaaaataagcctatgaattgtgtactattactaattaccatgctataaatgagaggcgtattaatctattcttgcactgctataaagaaataacagggactgggcaatttataaagaaaagaggtttaattggctcacagttctgcaggctgtacaggaagcataacagcttctgcttctggggaggcctcaggaaacttacaatcatggtagaaagtgaaggggaagcaggcatgtcctacatggctggagcagaaggaagagagagagagggaaggtgctacacacctttaaacaaccatatctcacaataactcactcactatcatgagaacagcaccacggagatagtgctaaaccattaatgaatgatccacccccataatccagtcacctcccaccagatccccaccttcaatactggggattacatttttacatgagatttgggcagggacacagatccaaactatgtaaagaagattcttgcttataaatgtgcaacaaaatttagctaaggatgagagccacatttctctctttactacatacatagtattatactagtaaaccttattgtaattgttattattattattaacacagaatggtatctcttggaaaaatacgcttacattaaaacattaaagctcgctactaaaataattttgtttttcattgattccagtttttcccacccactgtccatttaggatggcttcagaaaagagaaatggtgtcaaatctgaagcagtttatttagtgtcttcataaaaaattctgggatgaagtgggaattgctcattaaaatgcatacatatttttaaataacctgtgttttgcatttattctttctgcctctgtaccttacattaccaatgataagcaagaggaacatggcattcagatttagcagttatataactgagctgaaaaaaatctcaacatttaattaggaactgtgaaattgtataaacctgcttcacttttctcccattaaaaactttgttaacacagactattgccgcaaaatgcatttgattagacttttcttatttaaaaggtttttatcattattttttgataatttgttgttttttcttgctgtgaggattctaaaatatctagagcacacactataatagccaggaggaatccaccatatcatgtaattcaatcacacagatagaaactaacctagctagcatttgaactgaggcattcagaatctatttgtcaggtctgttctggatgaatacagcaggaaaatgactcaaaatgggcttaagaaaaaaataatatattggctaactgaaacgttcaaaaaggttgatgcttgtttgtttttcggggggtgggcatcaagcatgccttgagttaggtgtgtgaacaattccaagtttctttcctctgtgttagtttcggatttcagagatgctttctctatttggtggaaaattattgactagaatcttggcgtttatacctcactgtctcaaaaaacctcagtggaaagagatctcctcttcaagagccattctgcaagcagtcctggaactgaatctaattgtctctggttggtttgtcttcatccccgtgtttgtctagtcaaggtggctatgccctacaagcctcttatggcaagacctgaattatgtgctctcacctaatgccagaggtgtggtcagcccaactgaaatgagatggggaggattgggctttgtaaggaaaataaaaatgcaggttaaaaaaaaaaaaaaaagcaaacacatgtcctctgcagatttagaatccaggacattaattcttgtaaccatcttcaaaatggaacaatataacttttaaagcccagtactgtaccctgaatcttataaccttctccttaattgaatgttttatcagacttacaactccaaacacaattgagaaagaagaaaaaaaggaaagaaagagagaaggaaagaaagaaagaaagaagagagagaaagaaagaaaaagaaagaaaattctagaggagtttctttcttagtgagattttcttgtctcttttaagtctcatgtctcttgcgtttcttgccttttgctatcattctggtgtgattgtagctctgcagagcaataagttctcaacatatgttcacaattcatggtttttcacaatggttctactactaatttttttttttgtcttatatgccattcatgttcaattctctagacttccatttggatgtgtgtctaaagcctatataaaaatactataataagaaatacttaaggtttcctacagttggtattttaactaaagtagcacatgattagagcccgctgggaattctaattaattgaatttttaagaggcagaacctgaaagtataattttttgcaagtgatttattagatgagtttttagaaagaacccaaaggaaaagagggaagtggggcagggaagagatagtagccaagctcggtatactgtcaagcaaagttccacagaaggtaaatttgattcaatcctatagctctggagagaatacaggtcatacctagagttgtctcacaactaggagcacgggagctggagaagttataccctagaagccagtcatttattggttaatggctgctcctgggggtatgtaaattcctaggtactttcagttctctctttgtgaagataaattagctataacagcttgaggacagtgtccaaaaagagataacatgtactggctcttaagggtacaaagtacataggaatctggggcggaagagggattagaagggacgtgagtccagcactgacattttctgctacattactcgtctaagaaaggtgtatctaaataggagactccatttcttgtatcaaagggaaaaaatgcttgtccagtaagactttaatgttgtcactgagttatttttctttggacaaggtggaattctctttacacccacacaattgggccacttaaaatggagatccacttttgtaaagtaacaaatacctaggcttcaagggaatgatctaattaggtttgtgcaaaagtaatcctacttttgccatgacttttaatggcaaaagccgcgattacttttgcaccaacctaacacaacagctgtgaagtcagtattcctttgaattatactcatagcttctacttcaagaaaacctgaaaatgaatcccagctccgcctctttagctttagaaaagtaagtgaaattatatgtacgtattgtacagatacatagtacttggtactctgtattgtacaggtactgtgagtctgcataatatatgcatataaggtagctatttgttgtaatattattacaattatcataattgtcaaaatgttcagttacttaggtatttagttatgttaaaaaatgacttctgtcttcacaatcaatataaataactaagagcagagggaaaaatacacaatttttacttatattttgtctgaatgttttagattaaaagccttttcaattggatactttgcatgtatttgttataaatctcagagatttgctgtcataaaaagataaaggatcatgaattcagacaaatattagagctctatttttcctttgtaaaacaattttctcagaaaatttttattacactggtaatgcatgctcattgcaggaaaataatgaaaaccagaaataaacagagagcagaaaataaaataaaataaaataaaataaaataaaataaaataaaagacatttatatcacaactacccatagataaaaacttcacatgcaatacatacaacatatgcatttttaattgaataatacctcatatcctataaaattcactagacattgtgaatatctatgtgaataaagttccttctagaatttcgttcttattggttagtatgccataaaatgaatgaaaaagaacatcagttatctgaggttaattgttgccatgaatataccaatttactgaaatgtcaacttaaatttgtggcaagtggcaaggctttttaaaaggacaaaaacttagtatatgataataattattttttacttaaggcaattcaaaattcaagttttcactgtaattgtatgttaattctgagaataattgaatcaaacattgatttagggcacattttctgacaaatatgtttgagtgcatatgatttttatccttgtgctttatccttgatgtacataggaggataataattttttccaataaaaatgtctaaggcttcataagtgttcttgcttgaagcttctactgagacatcccaactttctgcagttgtttactgctcaaactctccaaatctttatttgccaagcactttgcatgtagttggatgagcctcccacattccttctgctgacttgaagaaattctgcctcttcttcaaggtttaccaattgactttgcaaaatgacttactaccattattattaatttgaaatataattagaatagaattattcaaatcatctaaaaatctataagggaatgaagaatgacttgacaagaggaaaggagagatattaatgtgaacagactggggattcattttacaattcattagtttagtagtgaatattttccttctggaactttgcttgcagcctgcccgttcttattttatgccttctaaaccattaatttctaaattcatcccttattgttaaacacttagtttcatttattataacatgtatttttgctcctttgaaagatacccatattagactaaaaataatagatatgagaaagtagacgaaattaatattaataaagtaactttatttacaagttctttataacaggggacaggctgcggtgtaaatccatctttgttttacttttttttaaatcgtatataaatgagtactttttttgaggatcatagagcctatttaccagttcatatgggtctgttttatagtgctgttttccctggataatttacctcacccatcccatgtcttcagttacctattagtaccagtttagatctggaatactttatatttttgccttagaaactataaatatatatataaagcctgcctagtcttaaatgtcatgttctcacaaagaatttccttgaccactataataaattgacataatcttgttactatctctgcactctatttcttttgtttcggttattgcagtttgcaagtgtacttgtttttattatttgtttatggtatgttttcccactagtctgtaagcaacataagggcagaggacatgtctattttattcaccactattttccctgaacatagcacagtgacttgcatacggcaggcacttaataaagtgttaaataaatgactgattgagtgaatggcgaatgattgcatgatctgaaaactagtcataatacaacagattgatagaatatttttcttgagagttatttgtatggatgctcttcttttattttgctgtcataaagattaaaccgtcttctattctaatgaggtgtaactgtttagtccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatggtgagctaattggatttcaaatatatataaaatatttggtaatgcccttcataataaattgtggaagtcattagcatgttgtgaaaaagtgtcacgggagaaataaggaaggcatatttccgggtttagatgcttaacacaatgattagcagatgggaatgaccacctttaaaatatggttttaattttagcatggtctatgaatgctattgtttattatatttgccttcaaaatatcagcagtgtcatgttaaagccataaaagtttataataaaaggaagcatgaactccatatatttcccattaaacgttctgcagcagattatagcaatcttgattctaattctaagtagaattaataaatgaaaaaaattgataggaaaaatataatactgcatggtggtttataatatttgttcctagttttcatattttgtctactcataagtaggtaatataaaaagaaggcaattacattatttaaaattatgtttgtctcagttacaaaaatctctcgtaaacttaagagagacgatgaatgcatatattatctaaaagctgtctttgtgtcttctttaatccaggattgaaattttctcttacttaacattaagtaaacaatacaatatatctcagaatttgcaaaatgctgtatactattaaaagatccttaacttctttgataaacttaatgtatctgtattagataatttttaaaaagtattgatatatggccaaaatactttcctatgtgacatgtttataatcaatgataaagtaattagagaaaatatgtgtgtatgtgtgtgtgtatgtgtgtgtgtgtgtaataactagaaaaatccaggatactgtaattatcccataggaatgttgattgagtgcccgtggggagaacatattgtgtgtctgtaatattattttccattttctttagaatttccaactttaacctgcaatgaatactactattttatatatagaatataattttctactcattattctcctacagttttagcaaacctagccaagaaaaacaatattttttttcagtagtacctacactttaaaggaaagtctttggaatttagtatcctttgtaaataaaataggatacaaatgggagttttagtagaatgaagatattgaatgctttggctagttttaaagaaatattttccattttatatataatagacaaagatataatcaagggatgaaccagaacacaaaggtatctgtaaactggaaatcaataataaagtacctttctgtatactgataaagcaaatgttagcttacatagcaattttacaaacattcacttatagaattcttaatcttaagaagtagaaatcttaagattaatattaagaggtagaaacaatgttcagtgatactataggcaaaaatatcttaagttaattgtgcaggatctcacagatagtgattgtcagattcaagatcagaaccttgaaatgtcttctgaaactgccatagcatttcaacatggtggtctaagctcattgtactatatctcaccacaaccaaattagccatttaattagcctgaaatggtccttgtaggggaataatggatacttagtcaataacataatcattatgtttcttagtcacatattaattcactttctgaagtgctttcaaaagaaaagaggattactgactcagttacctcagagttgaataataactgagaaattcaagaaaagaatctctcagtctgttatattgctgtgtttaagttataattcagaaccaagtaatattgtatatccatctatatcgtaattttataatctctaaaagaaatctctaaagtattattcatcatagaaaatagaacatgttcagaggagttaagtggcttttcataaccagtcaatatggcagaaaaaaatctaaaactcaaacctgtatggtagacccaaaatcctaagcctcttctcccatgaatttcctacctagttttaaatttaaaactttgctctccagaattttaatcatccaaagaatgttcacgttgaataaataaatgtgttctgtagccgcaattattgcattaagcataaaatcagatatatctgaaacctttgtaagttatgtgaaattacatatgagcatgcatttattttcccaggtcagacatatattaggacaatttctaaacaaatacttatgaattatataattttgttaataatacccagaaacatgattcaatttcaccaatagatctagttcttctaagttttgccttgatttgtccctcaaggctgcaggaagcacattctgtaactggaagttgtcctgattcctgcaagaggtaatcctaggcttagttcccaccacccagagacatcatgatttcttttactcgtttgtagtctcattgaagggtcttctgtcttggtgaaggcaggttgtgcagtagaaaaactctagaagtcagacagacttgcgttttatattgtgcacaatttcgaatcctctcggccctgcttcttacttcagccactgctacggtggccagttcagcactgtgcgttgtagatgtaacctgaaggagtgttgtctcaggtgcaaaactaccaagcacatcttgttttctgttctgggttttctttggctccttcgtgagcctactcagcatttaagcatgcccagtttggatgtgccagtagtttacacctgcactacccttagatgaccatggatgggaactaaatgatcccccttcatttccctgggtagacagctctaaagactgcttagaagttgacataagatggagaacaatggatcgtgttggtggtcaactcaataactcagccttgcattgacttttttttccttcccggtgactacctttttttcctgatgcttttcccttgggctaacattctcaaatgaacatgtggaactcaagccctttacttaggttctgcttttagggttcaaattttggcttccctgttttctaccatgtcatcttgaacaggttacctaacatcgctgcgagaatccactgaaagattgtagagggaattaagtgcaattacaaatataaagcatctggcttgccacagcctgagagtccaagggaagcgtcatatacttctgtatatccaaggacagaactaaataaaggagagggattaattggcacctccaggcagtttccagtcagtttatgaaagagatattcatgtgaaaacatttaatttccaacccgcctgtttccatgaatgatggtaaaaataatacaatcttactttcacgtcaattatgccagtttcttgttgtctcactactatgaagaactttctcaaattaaagaaaatttggaaaactcacacccagaattaaagtaagatactgaacctgtataaaactccaaatgttcaccattccttgtcaagaattttatctaggaaaaaagaatactggattatctttctaccaaaatgccaggaagctcatgtttgatttatgcttcaaggtattgagttgtaattgtgtctgaaacagatacagatttattacttttagtttagagcaaatataatcagtgaactttcagatttattccacaggttcagatttgatatacattttctaacttgacctatgttctaatatttagcatggatttattccctggccctgttctacattttgcccttttcccacagctcccaagttgttatacaggtggagcaaaatgacagatgacaaacatttaacttgagccaaatgcccaatgatatttgcaacaggatttctgtcaacccgcattgaagctcctgcatgtcccctccctcaaatcgtgtgtgtgcaatccaactggacccagttagccttgtccttctgatctctacagcccttgtaatgtagcataatgtcttggataactgccttttaccaaacagtggcacttgcctttttgaaacagctcctccagaatgggaacagaaaatccaaaatacacacctctctatctatgacaacttgctctgggaatgtaaagctagtggaaagccaaacccttggtatacatggttaaaaaatggtgaacgactcaacccagaggtaagcaactatgttgatattaaaagtttacctactctactaggtaaattttgttactaacagtactagtaactaacagaaacagctaatgttaatggagtctttggtatgttccaggaaaggatgcatacactgatttatttaatccttaaataaacttacaaagtaacccatctttcaaaagagaaaaataagtgtagacaagacaaataactttcacaaaatcactgttagccagtaatagattcacatttaaatatcatcatcatcatcaccgtcatcatcgacacggataacacttactgaactctcatatgagccaagccctgtgttaaatatttttccgtgcattatcttattgcaccctcatgaaaacattataagagagatacaagtattattcctttatgtaaatgaagaaaatgagtttcaaagaggttaggctacttgtttaaggtcacacagcagctagtaaatgttagaattagcattttaaacttttattttggtctgatatcaggacccaatctcttagtcactacccagtattttgcttttatgaacactgacgactgtctttaaacccctaggaaagtaaataactaaggcagttatccacatttctccatttaaagcatactttcttctacaatacctagaaaatgaaagatttgttttttacctattaaattatccagataattgtgtcaattctccattttactttgcacatgtaggcatagccagagacacaaagaacatctgttgtttggaagctgaatataatgctgttctttgtttcagcatcagtgaaattttcttcctgcatgccttttgcatatagcattctgtttcctccagcctattttccttttccctagaggatggtaatacatgccttgaaatatttagtcttaagttatatttgtactattaattatgtcactatgtgcactcaaaattgtatttctataccccacatggggttctgtaacagattttggctgtttaggcacactttatagtagtttgtagaaaggaaggatttagctactccaactcaagactcaattagaaaattatcacatcatcacatttcaaatgtttttgaaacttttggaaaatggaaagccaaggcagtgttctagtcatgatatacatgtctaacattattgttaaccgtgttttcctggaataattaggacggtggagtattccaaattactatgtataccaaataacagaaagttaacatacattttgtgcaaagtatgtcaattgtcaaagaaatgagataacataaaacacactagtaaccactaaaattatcctaaacatattttcgttttttaaacttaaaaatgctgctcagaatctagtagtgtattaatacaccaaattatcagatctcatagatatacacaaatgttgtttaataacatatcctggttaagagaatgctatattaacgtacaagcatctttatatgccttttcctttattaggagagaattcaaatagaaaatgggacactcatcataacgatgctgaatgtgtcagattctggtgtgtaccaatgtgctgcagaaaacaaatatcagataatttatgcaaatgctgaattgagagttttaggtaagtcgtttatttacaaccaacaaattcaaaatgacgttttaacaagctataattatgcataatcccaacccaattttttttgtaaattagaaattgctgtcccatcaaataatgggaaatgtctaaattaactttttacaaaattcaaggtggtaattattattctgcttgggcaatgcactggggcttcagaaaaaaacccaccattgggtgcatccaaaccggaggaagctcttccaaagctgattctagcatgaatttttgagtataactcaaagaatatctttaggaatattttcagctgcaaattaaaaagtaataaaaaaatcacaattcacagtaactaaaagaaacagtaatttattttatctcttagcaagaggggcattggctgccgggcatggcacctcaacttgacaaaatcctttacaccttcccttcagcatcaaagcctcatggttacaagatggctgctctagttatagaaatcaagtctatgctcaaggcagaagagcgaggttacagaaataatcacatttatctcttttattagaaaagcagaatttcccttagcttccatagtaaactttttatgtcattaactagagttctgtcacatgaccatccagacatcaagaggaggtagaaaaataagtccctatagtgaaaagtgctgagattaaagcaatttgagaatgatattttgggaagtccaaccagtggtgtctgccacaataaatgacgcgttgatagttttcaacccaagggtttcttagtggtaggaagaacagaggagataaaagagaggaaggatcaaacaacaagacacaaagttttatgagcttatgggtgatgagcactcattcatttgctcattctttctatcgctactgtttgattgaacatttattatgtactgagctgtatcaagatgaagtgatctttatcttcactcaacctataatttcaaggagaaaaaagtgtcagatttaaaatatggcaattcttatggctaagaattgaggagttgctatcgttgcacatgacaagttgaacataacctacattgaggacattccctttaatctaagatcagaagtaaaaacatgcatcagtaaggtgaagggtagagaagcaacatctgaaaagcccagaagcaagagagcatggcatacccgaaagaacttcagttcacttgagctttagattagaaatggagactggacacatggattccaacattcatgaagttggaaagattcagaggcaccctgatagcctaataatttcttgtccttctgaactggcatttgttcaacatatatttagtggggaaaaaaccgacatagtgatacagcatttctgatttatttcaatagtattttattgctaatagcaataaaatatttctgatttatttcagttgctaaccacaatacaataccactgaaataaatcagattggtatatatacatatataaatcacatatatatgtatatatgtgtatatacgtatatatgtatatgtgtgtgtgtttcttcaacatcatatgttccattgcttatatacatatataataaatcagaaacacacatacatatatacatgtatgcatatacatgtatatatatggatacacatgtatgtgcatacatgtatatgtgtgtgtgtgtttctgatttatcatatgtatgtatatgacatgtatgatcattgttttggctggaatagactttcctggtcagaattaaaattccttcttcggcctcttttgaaaccatcttcatcctctttgttgtaaatgctattagaaaagtgactttgtctaacttgcctcctctctaccacttgcttttattattgcaatgaccaccaacaaaacaaaaataagttgcatttattgagcctatactttgcgccaggcactatactataattccctgcaactgttacatcatttaatctccacactaactctctaaggtaatatcttttgtcatcttcattttacaaacaaaacataaactctaaaatgttaagtcagtatttggtccaagaacaccttgagcaaagtaacctgaaaagaggatacagctataaatattagattctgtctagcatagcaagtcacccctggagtcactacatgttaactgagtaattaaacaattttgtctttgattttgtttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaaggtaaacaaatctttatttttaaaaatatttttgtttgtaatataacatcttccaaatttttaggttttagtaggcctttcaaaatttcctcttttatgataaagtctcattggcatacctagagacgccagcattcttctcatcatagtaaaattgtaaaaaacaaaaggatcttataaaataaagacctgtttgtataagttagctgcaatattttcagtgcatgcacttgtaatagatttttaaaaatcttttaagacctttttctacattcagtttgaaggcttcctcctgaaccagcctgctgagaaatcagtgcgaataacatttcacaaaggagagagacactcattggcacacacctggtgttgtggtttttaaatagtcacacaggtgttcaccccatgacaaaatgaattcaccacatgaagaaatgtagagaggttcctgtagagaaagaagagaggtttcctaccataatggatacagttgagaaaccctaggtcagcactggcatgttttctaggagactttgacaaaagaaaacaaacaaacaaaaaaaaagacgggtgtttttctctacttgtaatatcttttattctattgtaccgtagagccttgtatacatgaggtgactagaccacagatgctgctctcttttaatgactcacatgtgttactctataatcagatatgcaattaaatcctaatgtgaacgagccattgtgctgaagatatgaaaatagtccctttcgttcaatgagctcttcttcagcatcatatgttccatgacttatatgcataccaggatgggcaggtaaaaggccaggtgaaagaaaggacaactaaagtgtgttaaaaaatgacagttgttactcttggaagaaatgactgtgacggactagaaagtgagttccctacctaaaaaggatagtcacaactccaaattctgtcaactggttgccttgcgggaaatgagaactaggtttgtagaacttccaatgtttcagagaaagctagaagtctgcattctggtattgaatctcccatgccagaaaaaagtagccataggatgaatgaagggacatcattttatcacttctaatcccaagatttcatttgtggccgaggaaaaaagaggtgaaaacaaacaaaagcaggggtctctgtggtttgtgtagagtccctttgtggttataactgctgccttgaagatccattccatttacacaatgaagtgtacatcagagagcccctttctagggcattctttctttccttattctctgcatttctttacatccctggactaaagcttttcccaggacaggaattatgtcacatttatctttgtatgtcctgtgccttggcacagaaccaaaacttaataaatatctgtggaataaatgaatgaatcaaaaagggtgaacatgtaaagcgttaccagctttacagaaaggctgttcttggggaaatccctcaagacataggaacaggtgcttcagaactaaggtgaaagaaaaggtgaaaggaaacctgttgtcctgactcaggttgggtctcttcttctgtgtgcattgcctaggagatttgctcccaacagatttagatgtgaattctttttaaatgtttcctcatgcattcctaaaatctaatcaaggtttgaatacactgctgtggaacagaaaaacataagagatcctgcagtatcaaacacagcaccttgtactgagggtctggacaaattgattaactgtgcctcatttaataaagtaactcacccaaggagcagaatgatggcatttaccttccacaagctttaaaggtccaaacacgaagtatgtgggaacaagaaagaaaattaggaggagaatttgagtaaagctaagataatgagagagagaaaaaaaaaagctaagataataagaaaaaaaagcaggagggaaactgctttttaaaacagctcttcaggtttttgttttattttgttttgtcccatacagaataaatttggggtcattttcacctcaccacagttactaataatcatatcagctcagcattgtctctctgtgattaagggaatgaaccctgtgagttctatttatacattattctttcattctatcttttcattgcttcagggtttcactgcaggtcttaacaaaagaaaacatacatacaaacaagcaaattatctccttactgtgcattcttaaaagttgaaaataattgagctctagcagaatgtagtaattacagtcactacatctccacccggtagagattacactgagcagtaattttcaaaaggtcacacagttaactccatgagtctatgtccctgcacactttctagcttgtcctttcttctgttgccatctgatcgactggctttattaagtgcatggcttcaagctgtttgttgagaaatacagcatctatgcttctgtttgtgtcagactattgccttttttatagtcttatcgtgggacttccaaacagattgaggtaaaaaattagagtagtgataagaaagagagaaagaaaggaaggaaaaaaggaaggaaggaaggaaggaaggaaggaaggaaggagggagggaaggaaggaagagaaagagggggaaagaaagaaagagagagaggaagcaggaagggcaagaagggtcactgctgtttactatagacgtggtgtgatatagtaaaaagatttcagcccccaccctgttgagagcctgactttggcaaagtcatttgtcttctatagaacttcatatgtaaaatgaattagaggtacttcattttcctaaaaaaggagagaaagtcaaatggtttcttcaagcctgttcaggcccaaggttgattatttcttctacatctttggtctgaaccattacgtggtagccaaattcttttttccctgatcagaaccccctcttctttttcaaaagagtattgacagaacagatcctaaatcctagcaaagtagctacatttagctttcaaattgtcatggctttaagaagacaatattaacgaaagctttggagaagacaacatcaaaatagcagttaatttcacaaaatatgttttcttacatttgaatacataaaaaagtttatttgattgagtatgtatgtgtgtatttgtgtgggtggggtgtgggtagatgggtacctaggaattggcatcagatttccaaagcaaacaaaattaaatatattaggagccagggacagagtattgcacataaaggttgactgggcaatttatttttagatttgattacaaatgcaagggttattgcatgtgtacatacactgttcaatgctatatttgaaaggagcactagagataatgtatcccattttccgaatttacagtgccagatcctaaactcaaacacagaacgctgagcccagtacacattttttaatgccacaccagactgattatttcactcaaatagcaatatatacataacttctaccatctcatacctctgttaaaacatgacacagttgtatatatatgaagaataaaaaagtcagatataggaaaaaagttcaaaattttacaatgattccaagtagaaatggtttctagttcttgaccttggaaatacctatgtgaggaaatgtacatttttagtttctgttgtaaaacttctatatggtactgtctactttgaaatttcattgtcactaactcttgcagccaataaagtataactacctagagatggttgagagggctctaaagaaacctattcaaagtaatcagactgaagtgctgacttataaaaaaatggtggcagtatatatattttgacaatttcttctagtcttacatgaattgaaacagcttccatcacacagctaataagtgaagaagcttagacttggtgccaagtcttccatctctgtattcacgtcttttcctctctatggataatggagtacacgctcagctcttcagtttttgaaaggctgttgtcacatgattcaacgtaatttgatgtgttgataattcagattaagttacatttctcaatacagtgaacatgtttcttattagcctatgtgccataattgaagtcttggctgttttaagagttctgttcctaaagcaaggatctgtatttatagcagcctgtcagaggagaaaagtgtttctcgaaccaaaaataggtagatggcattacagagtccgaagactgcctggtttcctgctgggaatgaatggtcatgcaacatctgtctcattctttttagacccaccagtggtttagaaatagcacttatattgaagagaagcaaaaggcatattcctgcaggagaaccaggaagcactgggaattagaaaacacgggttgtggtctcagatctatcactgataagtggcgtgacttgagtagaaatgctagactcctctttttattttttttttttttttgaggccactatttcctggatttatcttaagatgaaataatatgaaaacaactttaggaaatattaaacactatattcatgcagtgtctgcttgcacagagattacattttagaaatcaatagagaaccttagcccaaggggttgaaattgaaagttctatcttagttataactttatatatgttttaatgatttgcttgggtgaccaggtgactgagccaaacacggcaattgctgtgaactgtcaaaacagctaaaatgatttggttggatggattcagagtttacagagagccctatcagctaggctgtaagctccatgaaggcaccgagcaccattctttaattcaccattataggcctagcatccaccacaaacctggaatatagcacacattcagtaaatattttctgtgttgctaaattaataaaagttaaaatttaatttgtttaactaattttagagattttgcagctaagccaaaaattttaataattaatagaccgatggtatgattattcatttattaatttcttcattcattctgcaaatatttgctgaacacctattataacctaactgggtgctggggataaagtgttaagccagatagccacataacatataacattcttcttgccctttcttatgataatgtttttctttaaagtgatttgaagtcaaagatctgggttaaagtcccaactctatttcttagctgataacttctagcaagtcctttaacttcacaggttctcagctggttcatttcagagaaaatggtacttgtctctctgatgaggttataagagactcagattttatgtccggaatgacaggtgagctgtacacacactgctacattggatgtatttgttgctgtcatcgtaacttgtatgcatatcccagttgtgcatgcttttacctctggcagccaaggaacaaccacggaaaatcaggatgaattacagattaagtttatctctgcaaggcattctcaggcaactgagggaatcaattccacatctgctaagtttgattaatcacttctttttttccttgtggatctacttagcaagtgaactgacagaaatcaaagtcctagatttgtccccttatgcccagtgactgctgtctacctattcaggaatcacctcctgaatttaataggaagtgttaacccactggagagacagttcaatgttgttctctgacaggcagcattaaatacaattcctgaattacctggggtttggtcatagcggacatacaagctatcaacaataaaaacaaagagatggagaaaagaaatgttgtcctattattggaagaataccattatacaattgaatctggttgggtgcagtggctcatgcctgtaatcccagcactttgggaggccaaggtagaaggactgcttgagttcaggagttcgagaccagcctgggcaacatagtgagaccctgtctctgcaaaaaaattttaaaaaggaatggggtggaacatggtggcacacccctgtggtgccagctaatggatgggggtgggaacgggtgttgaggtgggagaataacttgagcccaggatgttgaggctgcagtgagccatgattgtgccactgcactccagcctgggtaacagagggagaccctgtttcaaacaaacaaacaaacaacaacaacaaaaaaatccctgaatctttggtaattgacagcattttctctcattttccttaaaaaaaaagcctactgcactttgcccagatttcttaaaatcaaataaataaaataaaataaaatacagctaaatgtcagaaaaagtctcattaataatgatgataaccactttaagcaccttctacatgctagatggtgtaccaggcactttacatatctcaaaacattaaagcacatttttttttcatattcagatatatttctgaggatcacaattgtcaccgattatatgattaaatttgtatcatttttaccctagtaatctcaaaaagttaaacacaaaggcatttttaaatttacagagaatcaaactgactcaattacagagattctaccccttagcaattggtttcagaaagtgattatattccccagaattgaaatgagcggacagctggactctctggaaaccaattccgttacctttatctacttactccaagtatatatatttgcagacaggtgttatcaaatcatggattctgtgtgatttatcctacaataatgctactgttaaaacctgtgtggccctggacacttggcaaatgcatgtaccttgtgggaaagagtgaacccattaggtgaattggagtcttattcaattattgaacaagcggtgcttcttcaatatttttgccttcaaacctcaaatttagagcagacccactgcacttccacctgcctggctccgcaatgcccagacaccttcctcttggacactatattccattgtgggaaaactacacaaggaaggtataaagatcgtagggaaagtggaaagtggaagaaggaagccaaagtaagagagaaggaaatggtagagaaagaaagatgagagaaaggaccagggaattccctgtgacaagatagaagtgctacttattgagcaagtcactggatctttcttttcttcatgggtaaaatggtccccttgggaagacctgtttgaaagccgttagcataatgcctgacacagacaaggaacagaaaaaaattagtttgtctttattcttctcattgctaagttatgtggacaaagcagttcttctagttacacagccattgcccaatacttagctatcattacattttcttcttggaggtttttccaatcatctgatcttgtggaggcaccagctaatgggagtctggctgcctgaatgcaagacagccaattatatgattcttcctccctgtctgacacttctctacatattttacaatatctaccttctaaattattactgttccttttgcttttgcctttacccccaagtgctcagtcttaataaaatatctccgtcgcacatgccttttcaagacaacattaaccattatatagcaactgcaaagcaggcttctctaccccttcctcctctttgcagagcttcctaatggaacaagcaaataaacttaattttattttgtatctccaactacttaatataatagtgcttagtacgtcaggtagcatgagtatcaaacaggcaaatgaaccatatgttcccctgtttaaggaagaatgacagtctgcataatgccaggcttattacaatctcccttctgtgctgcctctttgtaataaaattttaaattgttcatactcaactcctgagagccttgttaaggtgagcctttccaagggaatacatgttggagatgtcaagagccatctgatagtcttgcctgtttcacatgaagatgtaacaagctaaaatcctgtgtgtgcccctgtcagtcttgttttcattttcccctcttgccatccaattcccctttctttatccccactgacctccactgatctggggcactcacctttcacacagtgcctgcagaaccacccagatgccatggtctgaaaaagctccggttcattaaagttataaagcctgcctttaaatccagcctgcctaactcaatgtacgctgttttaccctgctgccttgtgttggcctattactgctgtagtccctctcccatgttttcgtgacaggtaaagccacccttggtggctttcaaccaagggtaaataggagaaaacaaagaagtttcacaaaataaatagcatcttataaattattaaactgtgtcttacaacagaaaatgggtaggcttccttgtagagtggctgtgaattcatgggctgcgatatcagtcagtttcaaatttgatcatgcaccataagaatcttgtgaaaaatgcagatcccagagccatgcccatgattttgatttagtaggtgtggaataggttaaggaacctgaatttgtgtaagttcactccctctgccttcaagagaggctgaagttgttgaataccacctagaggagcactggtttggtgcacacatatctacttagatagaaatgtgcttcattttatctctgttccaccccagaactttgattcctatcctagcagttcagccattcattctatctcactgttgaagagatataaatccttagttctcccctttttgaaaatgtgaatataattggctctagaatggtgtccacttattttacctcttgcttctaatttctgagtgacacttgtatcttcaaaattttacataaatattcaacagcaataattttatagacagaaaaggtcaattattcatgtaatttatacaaatgaccttttgttcttggtttgatttttgagaaaagaagtggttacttgataaattttaaagtataatgtccttttttgtttacttaaaaagaaaatggttgatgacagatctttgtcacacccacaccttctaatgccagtgagtgtatttaaaaaaataaataaaaataaataattagaaaaagcattgctgtctatgacaatccagtagaagaaataaaagctggagtaatagtatagaaatcagtctcattaaaaccttccaaacaagcagtgaagctgtcagagcactcttttttttttaagccactgactagaatttttcaattttttctttttttcatagtagaactttttaaattttttttcaaatgaaatgtatgcaagaaaacctttcattccacagataaaattgaactaatctggctaatgtcccggagggagaaccagaaccccactcaatgccctcctcaatccctctcaccctaaatctccatggtgtgccctagaaatcccctagctctccaaggagcatagtttgaggactactaatttgtagtgacaaatctgattctcaagtgtgacttgccaaacgattcatttatttataagtatagtggcaaaccaatttgacgggcgttgtgaaagattctgggtttataacttgaatgagctcagagtctcctggggaaggcagacaagcccacagctccggtgcagtggggcatgtgtcaccactaacatgtgaagagagtgagggcaattcactaacttggcttacaggagtctagaaaggtttcaacaggttgcaggtaactgaactggcagttgaagagtgagtgggaatttttcctggaagagaaaagtgggaggtacaggcttattacgagactgtcttactgtatatttggtatccagacttggtgtcatttcagaattttgggtacagatttcccttcctcaatacaagacacacttctcccgtgagtcctctaaatgcaagtaaagggtactcaaatcattttgcaaggcatccaagaattgactctttgactactcaaggaatgcttggatatacctaataacatatattttaattctatctccaattaaattaaccaaatacacccataaatctatcctccccatatttaaccatgagtttcattatataagaataataatgatgatgatatatccatttatatgctatccatcaagggcagatagtgtgttaagatgtttgatacatcatttcgttaaatttttacaacatacctatgagaggcatttattcatatttttagatgagtaaaactaaggcttagagaagttcagcatcataccgcgatcagtaagtgatagaaaaacattcagttctgagaagctctgactcaaagccttgtataatcttaaacacaacactgcaggattttaatgagatttctggtgtctatatgtggaattcaaggcagtccttcataatatacacatttttttgtttcttcagagttatactaaaaaaatcttctgaaaatagtgatatgcaaggtaaaactctatctttatgtcactaaaaggtatagaataagtcaacatgttgtccaaatactgatagatggagtcttatttattcacatcaatacaaaaatatcagttctttcagtggcacagcatcgtgaatacacaatgttcggaagactgattggatttttaacgtaacatacaatgtaatttttgatggcatggagaggtagatatgtaaattcagtaagcaggttaaagtcgctaagccccacaaaggaattaaaataggtataagactgtgtattataactaagaagaaagagttaaagttagcagacaaagagtcacacccaggttggtcccctattctcagccacttttgtaaacctaattttgtagactctgaggaatgctataattcagtagccaaagggaatccaggattggaaattccactagcatccatcactttcaaaaccatgttctatcttgatactcaagttttcagatactcatgtcctgaaatcatcagattacagggagctggagtgaaagggttaataatcattagcgttccagccctgttctctcacctttttatatgtgagggaagccgagaaccttaagtttcaagttggtggtttaaggtcatctgacttgaatctcatctgtctatcccaaagctttcagcagaaacaactttacatttataaaacttcaaagccctgaggaaatcacacaataggttcatagtcataaatgtaataatagcataggcagaatgtcctcacaatgttcagacttctccattctgttctgcataactctctcctctattgtattttcaatgtgttctcctctagtaactttgggagcatagtttgttggttttttttttttaatttatttctttaaagtcctgcattcacacatttttgtgtcctttgccaacttcatactttctagtcttttcttttgatttacttgggctataaggcatgttagcatatgaatctatgttaattctcttttgtgttttctcaggcatcccaaaatgctgcagcgaatggagacactttatctttcccttcttctactgaagagctaaatatttctctttggcctatttcactggattaatttagttaggctttccatctgatgctgttttgttaatgttaaattgtatttccttaacattttatgggagtcagcatagcagcacactctggcatgccatcagaataaagacacatcatggcaccaaataattacgctatttagcaactgctcttacctaccatctcctaatttgtgccataattcagtcaccgtgaatctgtgtttgtgttgcgtcagccactacaaagatcacacttaaattttttgtgtatattaaacaaggtgacacattatgataaatttagaggtctgaatatttgatgcttcctttctgctttggagtttaagacagttgaaccaaagacttaagatggaatcatttgttcactccagtaattacgcactagttgtaaatacaattacagacactaagaattctgaaaaagtagaaacgggcaccagtaacgttctcatttaaattaaaatgtatttgagtctatttctaatatctaggtaacccctctgaacaactatttgctaataaaaccctttcagttaactacctaaagaccctgaatcatccttgaaaaatcagttaatgggaagtatatccttagctatttaatagttaaaaatatgtatttctcgattttgttgaagagttgccaaaaaaaagtaacataaaagtactcaggtctatttcttttgtttgtttgtttgtttgtttgtggtggagtctccctctttcacccaggcttgagtgtagtggcacgatctcggctcactgcaacctccgccttccgggttcaagcaattcttattcatcagcctctggaatagctgggattacaggcgagcgccaccacacccggctaatttttgtatttttagtagggaaggggtttcaccatgttgttcaggctggtctcgaactcctgacctagttatctgcccacctcagcctcccaaagcgttgggattaaaggtgtgagccaccctgcctggcctgtctgtttcttttataagcacttgctttccagcaaaacatagcaaattggatttatttgttacctgtttatgatgtcacttcatgtaggttttcatttttgtttcctttcctttccctcttcctacggcccataaatatttaattacactctgcctaatataactcaatacagctgcccaaaggaacactattatttgcctggagctaggacagaggctaaaaaaaatactagagatcttattgcgacaattctgtgaatcagatgaatatttaggaaccaccaaacggggtctatattgttataataattaaaaacattttactctggcttgtattataccctttagtttcatgatcagaactgaaaaaaaataatgattaagatttgttttatacaccaagtcttatcctagtgatttgaatgtagagttgaccgttggacaacggggattgaactgtgcaggtctatttatacttgagtttttttcattaaaagttatactgactgtgcctgcctctcctgcctctcctttcacctcctccacctctttcacctttgccactcctaagagagtgagaccggacacctcctcttcctccttctcctcagcctactcagtgtcaagatgatgaagaactttattatgatcctcttccacataataaatagtaaatatgttttctcttccttatgattttcttagtaacatgatatcttctctagctgactttattgtaaaaatacattgtataatgcatataacatacaaaacttgttcatggactgtttatgttatcagtaaggctgctggtcagttggagactattagtagttaattttaggaagtcaaaagttacaggtggaatttcaactctgtgagaatgttggcaccccaacccctgcattgttcaaaggccaactccatttctttgcatcaacttttgtactgctttaaggggcatcagcaaactaacagaaagtcacttcaatgatcaaataaccacattgtttataagtataaagtttatactccttatttatacttataaataatgtggttgtttgactaaatcgctttctgttaggggactgaattgattgataatattgacaaatatacatctggctctagaaacaaaaggctgaatatttaacagcaaatgcaatcagaaaaatgcatatttattaagtacctgctaactgttgggcttcttggagaatataaacaaataaagaatattagctactaccttgggacacccattatgctctaggctctctctctctatatatatatagcataatgtatttaattctcaaaacaagatgatgatgttattactactcatatccccattctatataaagttggcatagaaatcaagcaactgctcctaaattaacatggccaaaaacagaaactcaggcacatattcaaagtgatctgactttagagtccatggtcttataatccctgtatcacctgcctcaaacaaaccttagcttttacagcatatttggagagcaaaaacttatctaaaaagaaaattaaaagtacaagacagtaaaatgatttagataatgactcagtagaaaaaacactgactccgtatcagaagacctgtatcggggctgcggttaagttagttattgaatctccctgcatctcagttttttgatgtggggagaaagcatatcgtgaactctagtgactggagaaggatgtgatagagaaagctgtatatcttggtggggttccgcaggaaacagtgctcagttctgcttctcagggaggtccacctgcagggcagcaatggatgattgtatcttactgcacacctgctgcctcacttcaagccatagtcacatcattggtagcttgacatcgtaggttgtcagctacataggttgcttccagacaggctgtatagagaaaccacttgggaacagtctgtggaaggaaagaaaaagggattaatttacctgactgcccctttgctggtggagctgctttacctgaacctttgacagtcagtggaactgagagaacctaaaagatttcataaggtgtgtctgaaacactgggaatcaaagaaggttttggagggtgaatgggattcagataagcagattggagagtgaaacctctgctagatacgaggagaagagagtttaggcttttgtctggcaggttctgtgaaggagggtactcaaagaaagatttgcaaattataaacatttgtttcctctttgggactcacacaactcttccctgaaaataaatatttgtgttctttccccaaagtcagacaaaataaaagagatgaatataatatttaacagtcctttctataaattttcctgaattttttgatatgtgtttcctcttgttcagaactgattaacaattgtctgtgcctgtgctttgctgaaagtgtgatctacgttacttggtacagtggccagatttaggtttgtttcctctggtccctcgatcatgtctctcttgagacagtacttcattttcacttcatctctgtctcttttgctttttttcatttttactacattgatgatcttataaggactgataaattaggttttcatcaatccactgattaaatctttgaattttgcctggacaggggtatcagatgttctctgtgtttaactacttatgtacaattactttttttttttttttgagacagggtctcacttagtccaccaggctgtagtgcggtggcacgatcttggcctactgcaacctccacctcccgggctcaagtgattctcccgcctcagcctcctgagtagctgaaattacaggcacgaaccaccatacccgctaatttttgtattttcagtacagacggggtttcaccatattggccagtctggtctcgaactcctgacctcaagtgattcacccaccctggcctcccagtgtgctgggattacaggcatgaaccaccatgcccagccatacaattacttataattaaagttactgacataaaatgatggaaaggacaacctttattttgatttaaatgagcaaactttgtaatttacttgtttgtagattgactttttatgtggtttgttaaaataagaaatttttaaaagatagcttattaaatgacagtgacattagcatagatattacacattaactataataattgggtgcaaaaatcattaaaatgcaatattaatatttaatctaaaacagattccggtgggacattttaccacaatatcagtatttgatctaaaatagattccagtgggagattttacctaaaacttaaattgtgaacaggaagaatttatacccacatttctatttcttatctaactcattttaataaaatcaattttacattttccaaatatcagtaaaattagagaatcaattaaaatttcatggtctacagcattatctttagacagaactggaagcaatactccagttaataatctaactataaaaatagcagtattgctctagtttcagcaataagaaattataattgcccgatgacctgattttttttttttttagtttaagaaatttagctatttctaatcctctttgtcctcaaactttgtacaaagttatggttgataccaaacaaaaaatctggagcatttcttattttccattcacaccttggaatctacatgtacagatctgttttctgtatgtaaataaattaaggattgggtagatattagatttgttatagtgacaaaaaaggatgtgaatgttaatctctattgtattgaaatagtttagttaattatgaacaggtattagttcatacaatgcaggtgctatcgtttggatatggattgtccccactaaaactcatattgaaattttatcttccatgtggcagttttgggaggtggagcctgtttgggccttggggacagatccctccttaatgcattaatgccctccctctgggttgagtgagttcttgctctcttgagaatagatttgttcctgctctcttgggaatagatttgttcctgctagacagcgttttaaaagagtctggcttcctcagtctctctctcttacttcccctcttgccatgtgacctctttgtacacaccagtttctttctgctttttgccatgagttgaagcagcctgagaacctcaccagctgcagctgcccaaccgtgagccttccagccaccagaatcatgagccaaataaaccatttttctttataaattactgagtctcagggagtctgatagagcaacactaaatggactaagacaccggaaaaacgagggtaaaatattccgcattagtctcgatgtagttccttaaagtaacacaaaatctgatgcacatgctgcgggtaaagaagccctccaagtggatgtgatgtgatccttctccttcctggtgttctgttcataatgacccatcaaatagaaggtaataggtacaaagtcaggcaaatgggtaggacatctgttacttttgttttctgtgtaggactacctaccttccctgacagtgggaagattaaaatgtcgcatgttcagctgctctttaaaaatctgccttcaacttatcagttaaacttgaaatatttatacgttattggcttagttttgtacatgctctatattctaaagccactataaaatctacccagtgtcacttaactgtcagacacagcttgttcttctgaattttgactcataatgcattagaggaattgcatggtacaatacaaacgctattaatttttctattagttgaatagtcatactatatctacacatataaatgcctttaaattctaattttacagaacattttaaatgcaaatgctataatcagtgatttaattatctaaacagaatattgaggtttggtaatttggggaaaatttttctatttaattgtgtgaacagttaaaatattctaattaagtggatattagagaataaagacatgagagaaatggcgttatcactaaacttattgaggaaataaggaggaaacataccaacaccgtaagtcaaatgtcagaatttggtgatgccaaaaccaaggagagtctggggactgataaccagagcttagttaaagccacataacatgcttctgagtccagccataggcaagaattttaagaagacattaggcatgagcaacaaacagagtgagaatcagaaatagtaactggagtcttggaagagagaaaatgtcaaatattagtatcagctaagaataagaattagattaatatctagcatttaattaacttttacagcaatcacattattattcctaaaataaaaattagagcattgtagatcaaaaagattaagtagctaagaacacagacaagaggttgcatgaattcacggaagggttttaagcagtgaaacttaatgctgaggacagttttgctggcattagactcctttcgaaaagcccagatatagttctcaggcctctttgttcaaaatgcagtgtgataaaacaatttcttctttccttgtttattcctcatggagttatagatatgcctacattcttaggcaggatgagaaatcagttcattgaaagcctacctattgactgctaatggagtccggtacagtgctaagcattttgaacgatttatatcaattaatcctcatgactctgtgacacaggtaatattagtatttctatgctatagacaaaaaaaaaaaaaaaaaaaggacttgggccattagttaacttggcccagtaacacaaaaatcaaatgttgggattcagattcgatcataagtagtttgtcctcaaagcccaagtttttatccactctgctaattacaccataattgcacaggatggcacaagaaaagaggaaaaacaatccttagtattagcatgaccattattagtacctcacgtgttaagatatctatggttaaaactctcttccagagcaggggaacggatattaagcctgtctttaagatgccacataaactaagaatcttgagaaaatgcacatacatgtacataaatgttgcatcacattttagagagttattagactctgaaggtcagattttaaatcttcaatattaaaggtcattctatgcaaataaaattatacatacatatatacacacatatgtacatgcacatatagcttaaatttatgctgcttttagtaactctgctattagtaaactatattttggaagtgaactaaaacggaacttgctaaaataagtgttttctggtctgaagaaagatatggttagaatctgagccctccgccatctagtgggtaccttgagtcacttattgcttctctttatgcctgtttcctgatttataaaataggggtgcaaacaatacctagcccagaagtttgtcttaagcattcgatgagttgacatttattacacacttactagagggcctgtgcagaaccagctccctataatatgtcatagcctccataaatttataacaatgagttttaatatggaaaagagcacctttaacatctaacactttttattttcgcatccccattgtaacacctaacataccgtttcaaacacagtagacatttagaaagtatttgctgattaagaaggaaaaaatatcttaacattgctccagtttcaatcatgtatttaaactgctgttgaatttttggaagtctcccatcatttcatggtgctcacaaatttccacacatatttttatgactcattatatattagtagtataacttcaaccttaaatcctcatataataatatacatataatatgtaatcatggtattaccttctgcttttttccctgtaactatatgctttgtactaatcattcatgcaaatctctacttttattatcagaatatttttcctgctttttacagatagccaagcttatctattcttctggctgtgtgtgtttttttttaaatgccagagaagcatatatgcaaatgaaggtagaatattttaatgtcgttcattgatatgttattaccaatccttgagataaagtatcttttttgcatattgtaaaagaagaatagaaaaaaatcagtctctctctatgaatgttaccaaaaccatcaattaaaatgttccagttaattcttacatgtgcattttgccttatctgaaaatgccaattgctcagtgccatttgatcttcactgagtgttccttcttttggcttttttaaaatcatttctgctaagacgtgtttagatatgttaaaaaactggaaattcttttatagtttttgtttaattttttcttaataaaattaagacaatgatcaggttgtttaattctgtttatattgtcatgagattaatttttttaccatattttaatatctcattaattaaaggagaaatctaagtgatacattcaaatatctgtactgtttgttatgccataaaatctttagttatgattaaatctttgaatgtctatatcctagatcaacagagagaacttttaaagtttattttaataaatcataaatcaatttggttactagtttggctatttttataaaacatttaaaatgtatgttattattcttttataaattattttcataagatcataagtaagatgtagtcttactttgaagtaaagaaaaaattttcagattaaagtttaatagtaaatagatcagtacttctcaaacttaattgtacatgctagtcactgtatgtactacagtgcatagggtgtcttgtgaaaatgcagtttgattcattaggtctgggataagaccacattttgaggagtaaacacatggaatatctttagggcatctagtgatgactctgctgaaacttcttggaccatataattaacatgcagaattattttactaaacgtaaggcaaagtaatggttctggaaaaagcctgagtactaggataattagatataacttcattctctcctacttagctagttagtctagggcagattttaacttttcttagtttgctctctcagtaccttaaacagtagtaagtacttaagaaatattgatgtgttgattaggatttcatagaaataatcagcctcaatgatggcaatttcaactcgatttagcaaacattgaagacctactgagcctgaaaggggtagtatactcagggtaccactgcacacttgaattattcctttctggaagttatgtgaaaaattatatgaaatatagacattggcattgacttagtggctggaaaactttcttggtggcctttagatatcagcagacctatcatttctgtcatgtgttttttattggccaatagttcaggtttctgtgttgctcaatattcctagttattcctaaatgttaggggtagatgcacccaaaagcttctcacatttacctcttataattcaaatcagataaagaattatatttggcctgagtttggtgcataatagaatagttttgttactctgtcaataatggcataattcaattgttaatgtaaattgggatctagtacactagacatctcagaaattaaataagacattaaatgtctgctatgggagaatactctaagataatgactttaaaaaatctgattatatgccatggaacattctaaattcagatgtggctccttccactcactgataacagaatttggaatctgttattaataataaatccaacgtcagaagctggcttcctgcaaattgtcgttggctggtattctctgtgtttcaaattgagtaattaattatattagctacattttgtgttatacatatattagaaacaacgatatgtttgcaatgcagcaaatactattttgttattgttaatggatatggcatgcatgccaattgtctagcctttcttgcctttaaaactgttgttaaaaattagtatgttgtcacacattttgatacaatcttgactacctactaatgtttttaaaaggttggtaactacatttgtaagatataaaatatggtagcctaaaattggacgaatatttttgtttttacattttttcagtctcctcttattacatttgatggtgaatttttcagggaacaaatctcagggttttttttttttttctgatttcagtggcattgtgctttagactatgctagagtttcagagaaaatttaatatggattattttatgaaagatgggaacttctttggcagatgaacctcctttttgtactctctcttttaggaatattaatattaattcataattaacccatgaagccttattctttctacttcttccttcctctttttgatgggatagccacataataagcatggccctctggccatggaaccatatagatagtttcttcaactcatcagcactggcaaatactgtcgtggttcaacaccccattctgtggccacagaaaatgctgacagaccacgtttaaaaagacacagactaattgtgaaaattagcttgcatttctcctaagccaagttcaatttttgccagtgagttgactttggaaaatacagagtaaatagttgcatttcttattcatcaagcaacttgacattatactaccaagcactgcttttatttttaatatgctttgaaatcgacaatgataattcaagttatagaatgataattatcaatatcgtgtcagaataaaagcaaatgccatttactgtaatatgtagactcagagatagctcacaatgaagaacagaataataggaaaggaaaaaattcatattatcacatacacccatgattttagtaaagttttaaaataaaaataagcacttatgatttaccagtgttgaagagccttacttctattaatgatgtattttctttttagaatatttctcttggaggatggcagcctcaagatatataatattaccaggtcagatgctggatcatatacatgcatagccacaaatcagtttggcactgcaaagaacactggcagcctcattgtaaaaggtatcatattatcttcatttgtgcttgatgaacattgtaaatatgcaggcatattatgacttgtgttatggtgtcaaacctgtaccatattgtgtatgtaaaattgttgatttcacaagttatctaagagatccattcccgtactcattaataacatgcacactttgccagtgggataccatggtagatgtgaatactttggcaattgaaaatgctgtcagagtgtcattcgagttaaaacctacacctaaattatttggctttttacataagccttaatgttaggggccatggacgttttgataaagtcactggataacatttttttggtcaaatatctttcagaatctttatttttatttgaaatatttacatgtatataaggctaccaaatacataactggctaatttgtttatataactccaggtacaaaactaatgaaatgcagggtcacaacctttagtaagcagttcttttcaaagagaaaaaattaaaatctgtgtgaatcattattatattttcatcacagtaagcagataaactcatacaatttatagagataaattctatactttacttttaagatttctaaatcagtatcaatccaaatgttcctacatttatcaccaaggacataattaatattagaagtatctattccctttccttgctgctttattttgttgaatctcagctcataaaactagtgtgtttactggaagctgtatcacttctatcatttcattgcctcctggatgataaaaatggctctcttgataaagcagtttaagcagctaattaagcccaaatgattaaaatcagcatttggtgctttctcatcttttccattaaaataaatatattcaataaaaagtagttagctgctacacttcaaccatcctttaaaatatctcaaggaaaataaacacccacctttgagcctggaagatatttctgccaacttgtctcaagcgtattacattatgacgacaattgtctgaagtattctggggaaatgtgactgataaaacttggtgtgtcaaaatccaaccagtatggcatattttgaaaaacttctcttccttaagattgtattgtcatcaatttttaagacagagatggacttaagtgtttcaagatagatgttatggctatatttaggaacagactatttctccagcaaatttttggcaatactcagacactgaaaaatgtgaatgctttatatttggaaaagtaacaagttcattaacgggaaaaaaagatatttattatatcatttcaaattaagaaggtgtaggtagtatgcaaattttattacagcagaagattaaaatgtggtgaaggataaaaaggcattttgcagttaaatcttctaggtatggaaaaatccagagggcattaaaacgtgaaatagaagggatagaaaacatcagcagtagcaatgtagtttttaaaagaaagtttctttagaatactggtgatctgggaggagggccaatggttttgctgttaaaatacaatgatggggattccttcactctggaggataagaaaaacacaagttaatggtagattgaactgaatgaataggcactcttcctccagtgtttcttaaactttgacatcataatattcacagtccactaataactgatgaaagaaaaataaaaggtgacggctaacaaaaatactaactgagaaactcggaagccactggactgcattctggatgtaacatttgcatatttcagatgtgtaatatagccatgttttctgcaagttaggttcctagtacttatgatagaaataagtttatctacactttcaagtattccataaatctaaccataatccccagctactctgctctttccataggtaaaacaataattaatcaagatagctcagttaacaaaaaaaaaaaaaaaagcctgacttacatttttgtttgttcatttctagtgctctttgctgaggttgttgaaacaaaattatcccactaggcattccttgttaccttaatcagttccactctttcttcttctgtaccactttttatcttcttacgaactgtataactgacttacttattatggttttttttcttgtcttttcttcccttctagaacagaagcataaagagggcagggatttttgttttaatcaatgatgaatcataaatcctagaacattgctgggaactgtatgtgcccagtaaatatttattgatttaataaaatgttattatcttatgcagcttagttcatagggatatttttcatactggcttccttgctctaaaatcggacagttttcaatttttcagggtctgagcttcttaggacactttgcaaaaaaagaacatcaaagaaaaaaaccaacctttttacatgcattcactttctaattgtagggtttgtaatcttttatttctgacagacatcgatcacctcactctcctaagggggtacaagcctgaacctacatcgaaatccaaaaattcgtgaagagaattcattgttttggtatttctagcacagtacaggagaataactcacatatacaaaaagggtacatgataacataactgatgtcactatgcctgattatcaagttactttcatgcatttacacctaataatgggaaggaaattttgctatattttaaccttcatgacacatccacatcccattttaagtggactttggggtcttttgcttctttgtcattaacaagaactatcctatgcaatataaacatgtacatacttaaccacacaaatacatataaataaaataaacacaaaatgtgtgtacagtatgaagaaaaacagccttagaaagttgctttattatttatctgtaatgtttaatctttatgaaattgtgtgactgtcatacaagcacagttctaagtctattattaccatgtcctcttaactagactgttatctctaattccctttcatataaaaatgttgaagacatcactgccaaggaattattattttacaacctacaaatttgaagcctagcataggaaaaaattataatagtgtacatcaattcaaccattttcttgactattgggtgtatagtcatctggttgtttcttaagatggcttaatagttgtgtatatatgtatgtgtattttctcatcagtaatattcatatgattgctgttacagaatcaaatataattttgtttctcaagccaaaatcagtgtatagtgaccttaagagtaatagagtgttaaggagcaaatgagaaatctcagtaaagctgataaaacaatcatctccctttgaatttacttatcagcctctgtcatgcaagaaatgttgttgttagataacatggaaaagataatagttacaagagtgagatattttccagcttagtttttagctgatatggcttatctctgttaagaggattctgaagttatctgcactgtatgttggaaatttctatttcactaatacagcaggataaggcgattttccattcaaacattgtgagtgcaattagcagcagcttttccagcgcctcagaagatgcccagtataatttaaggacatgtttcagaggcacaaacaaggaatcaagaggaaagagagtttacgtgttttcattttggaggactgagattaaaattacaatgtgtacatacactaagaggtatatgaaaatcacataaaaggagaaattatttgatctggcatttggaaaattattaaaaagcagagtaacagcaggctataaaaatgatcttgtttgcaggcaacatttgtttttgtttccccactggagaagttttggatgttcaattataggcctcattgcttcagtgttattttcaactgaaatgtcggaacttggaaaagcatatctaatgtgcaaattaagtttattgctgctcatttagttgtttattcttcgtgatagaagtctttattataccagcattacagagtggcctatccattttctccagcagaatgatacgggtctaagtttactaagagaaatgcccaagatatgtagataattggaggcttcgtggctctagaaggcagtttgaaggatttgaggtatcaagctcagctttattgacaagcccagtttgattgagcagaccaaaagtacactttcagagaaatgacaagatgtattggaatacatttgtcatatcgtagtacttgaaaacaccagagaagtctccagcagcactaaaatctccccaaaaatgttcagttccacacgccactttcctacacagaatgactgaaagcatttcaacagaatgaacatttgatttaaaaattagtgatggtaaaaattactttcaaggtgagaaaatatataaggagttattatactggtcagatgaaaaaatttcctgttccaatattgaaagtgatgctgcgtgaattattgaaacgtgaatactacaatctcttcaagtaaaaatgtaaaaacaagcaaaaacacgcatcaatttaagcaagcccactaagatcaatgttgtcttggtcttcatgaaaatttagttcacaatcttttttaaaatgcagcatatgtcactcagattaaattaccacatatgacatatagctgtgttttttcttaatgtatattttacaaaatataatgtaaaggatagatgttaatacagcataggttttaccacttttttcaagatatttttactgcatagtttaaacctattattggtcaaagttttgtttaattttgataaaaatagggggtgtatagctagtggtttatgccagttgaaggagaccagacacagaagagtatagaactcttactaaagtggtcaatacacagcctctggaattatattaacctgccattactaactaacgtggaacttgacgacttagtttttatggttattcatcttgttttctttattattattattcattactatttgttaaatacattctctgtcctaggcaccatgataggttctttgtgtatatcatctcatttcaactttcagagtaatgctttgaagcagatattattatctcaattttatacaagggagattgaggaataggttgctaaaaccacttgcccaaggtccctgcattagtaagtggcagaactttagctttccttcttttccatcttccaacaaatgtacatattaaaaaatgcatgagacaattttacatcgcattgttcaaagtctagcaggaataaaagtatagtaacatgcagatattagtacttcctcctaaataccgcagccttcattcattagagtgcaattttatatgtacatttttatatgtaaaaattcatttgagtgcaatatttatgtgcatttacattttattatatgtaaattttacataaatgcacatttatgtaaatgcacatttatgtaaaatttacatataataaaatacataaattttaatgtatattcactaaattttgaaaatggcatttgtaacccaaaacacacaagatatagaacatcattatcatccaacatctagaactttttttatgtcacttaatccttgttcctactacactcctagaagcagctactgtaataattttctcaccatagatttcattcaaatgctaccttatattgtgtattcttttgtgtttggtgtcattcatacagtataaaccactagctatccatctcctatttttattaaaataaaaaaacacttcaaccgatacgtttattctgcaggtaactaaatgcatatatacatgtatgtatatataaatctcaaactattaagtctttttgatctttagtttcctgcccaaacctgcaaacacttgtgctcacttgtttcttgagtttttagttaagaattggaaatttagtaaatttaccttgactctattctgaccgtaaaagaagcaattaggctactcttcttcttaggcattctctctctaaattagctcagtggtcacttatgctctagggccattttttttttttttaggaataaactatgtcattaagatggaaaagacttccccagaagcaagctatgttttcagtctctggatcctgaatactcaagcaagtagttaccaaatgctttcaagtccaaaagaggaatggggttgaagggcgtggaaggggaaaaaataatcacatgaatcaaacttagccttatcctctttttttgggttttattttctcattttgactccctcatcccaacatgaaacgttcagaagaaaatatcatttgtattaacacctattgacaggcacaataaaaatttctactttcatcttctacaaaactacaggctgggtgtggtggctcatgcctgtaatcccagcactttgaaaggctgaggtgggaggattgcttgagaccaggagttcaagaccatggcaagaccttatctctactaaaaataagaaaaattagtaaggcatggtggcatatgcctgttgtcccagctacttgggaagctgagatggaaggatcacttgagctcagaaattcaagattgcagtgagctatgatcatgccactgtactccagcctaggcaatacagcaagatcctgtcccccaaaacaaaaaaggtacagaagtcttctattgtataattcgctacagccagcatgaagttactattggagaatagtctgaatgaacactatctatttataagaaatataaatatgatgccataaatatgtagtcactgcctattatgtactaatagctttgaaacagagtagttgtcatatctaatttattacacagaatctacagagcatgttctgtttaaatagatgtcaggccctgctttgactatttgttaatataaaagatctgtgtttacattttacaatattatttgctagggaaatagggtaacattgcatgttttctcatttagacatctcaacttttagacaatgctttctctagactggtttttcacttgtttcttttaatctggggttctcagtagtcttttaatatttattccaaaccatttaaatgttgaagtagtaaataaatgagtaatggtacctgaaggtaaattggaatatattgaccatgattactttatgcattgaaattaaattttactctgtggtgaaatatgataaatgctgcatgtagattttaatctgtagatacacgtgtgagcagataatcatgcacttgtctaagaggatataaaacattttagacttacggattgtatttgcaaaaaggaaaagcttattaactaaagactaaaaacaactcctttatttctggcttgctacacctggagaaatgaagaccccatcacaccgatttccttgttcgtttgcctgcttttctctgtccaaggtttatttcagagtattagctttgattttcctgtgtttgctttcccttcttttgttcgtttgcttagttttctacggacttgccaacaattcatttcccaaatctatctcaatagtctcccttcaatatcagcctgccctgtgtgttgacgctccattgcctaactccatgcctttctgtttcttaacatactccttcactttggttgattaaaccttccagtggatttttgagaaataatccaagagatatacaatttttttaatctttcatgtttgaaagtgtctttattctgtgtttacattttattagtggtttagtttgaagtagaattctagactggaagccattatttctcagaaattttgagccgttactgtgctctgaaagcctaaactttgttgatttctaatctgttgtttgtgacaccttttccctcttgttctctagaattctgttttctccaatgtttgacaatttcaagataatgtgtcatgttttaaatctgttatcaactattacactgggcatttggcaggctttgtcgctgtagaaactcatacttcttggtcctaaaatatctttctgaataatttaatattttattccattccttctcctaaaagccctgttatttaaatgttatattttctaaactggtagtctagtttatggttatattcatctatatgtatgtatataaacatacatgtatattctatacacattctatatattctatatacatgtatgtatacacgtattttttttctttttttctctcttagtcttcattttatagctgtacctaccctttgtatctcatccagttttatgtttctaaatattatctataagttaattcccaaactcaaatcaagctaattccagctcagatatttctcttcaatccccaaattcaacagcctattttatcatcttcacttacaaatttactatatcctaaccttgaactcctgattcttactccccaaacttgtttctactgtcttctttctccactatattaatgacagtctgcactgacagttgtttagaccaaatccttgagattatttttaatttttttctttcatttaaaccccatattcaattgccccaaaatggtttcagcttcaaggtacatacagaatctaaccacttctctccgcttcaatgaccaaactttaagccatgccatctctttcccagagtattgctatagcacagaatggctcaaccaggatgattttgtctcccaggggacattggcaaaatatgcaaatatttttggttttcacaactgaagggtctcacccgaccccatccgctgccttgcaccacacacacgctaaacccacaccttgacacacacaagaaaaaattatttggaccaactgttgataaatgttaagcttggaaacccagtaatagcttcaaaagcatttgtcctaattctttgtttcccttctagaagctacaatgttgctattaaaatataggcaagattttgtcactcttaggactgaaatcttctaatggttcttcagtttggttttgttccttttgttcagcattcctactgatgtataatttggaataaggtaagggtgcaatactaattaaatggttttcaatagatgattgaataaacaattagtacatttctatgttaggaatctctacttctgtccaaaattatacttatttctttctctaactgacagcaattatcatactcttcaagctattatctaaaaacctactgataaatggcctaaatatttttaccaatacacttaatctattatgaaacattaataataaaggagaataatctgtcttaactagttgaagtaagcttatcacaccaacctcccactgatgttcaccacaaatattgttaaaatatttaaaaatgaacaaaaacagttttttcaaggaattgtgacaacagccaaggtgtttgcaacatgaggtgcagaagcctggagaaaacaaaagcacagagaggttagccccacattccctgctgtttttcttctcagaaatttgtcaattcctaagcagtataaatcaggaatgaagaaaccaatcagaaagtagaaaacatctcagcagaaattttggtagacttacagtgaaagggagacacaaatagaggttcagaataaaccaaatagaatgaagtctgctaagcagctcaaccttgagtcaggacatctgaaggactatgtcctagtaagaaacaaaacaaaataaaataaaattgaccaggacttaaaatgactaagatccagactcaattcatatcagtttcggaccagcttctggctctttttataattgcatgcttgaaaaagtaaatcttcccggtacaaatataacactataaaatcacttacatttttgatccacaacgtctagcattcaataaaacgttactaggaataactggagctatgaccaaatgaccaaaactcagagaaaaaaacagataatagtaacaggtcacagcgatagaaatattgaagttctcagacaagggctttaaaataattttgattaatatattaaaagatagatgacaagatggagaatttcagaaaggaaatggcatctgttaaaactccaatggaagttctagaactgacaattgcaagtgctaacattaagaacagaatacattgatttaacacaaggatagctataacagaaagaggattagtaaaggggaggatgcgtgaatagaaaatgtctaaactgcagcatggagagagaataaaatgggaaagacagaaagtatcataaggaaaatatggaatatagtgaataacttttaacatatataaaattgttccaaaaggagcagagaggacagaaagaaaattaggcatgagcaatatttgaagaaatatttgccagatactttttaaaaactgaaaatgataagtatccaattcaagaaattatgtgagtcccaattcagacaaatgcaaaggaaagcctagctaagcacacagtagcaaaactaaagggaaaaaaatcagataaaaaagatacattaagtcaaaaaaacaagactagcagttgatataacaaagaaaaaaggaacccagaagaaaatgaaatgacatttttaatgcgctaaagacaataccaataagaattctatccctatttaaaaatccccccaaataaagacaaaataaagatgctttcaaacaaacaaaacctgagagaatccccatcacttaaaaaaataaaaatttcatatatttaaggggtacaacaccttaaatgtttgacctacttatgtgcaataaagtggttactatactaagcaacttaacttatgcatttcctcacatagctgcctcttttgtgtgtgtctctgcgatgagaacacctgaaatctaaactcttggaaagttctcagtatacaatacagtatttatgatacagtatacagatatatatatacacagataactgtatcattgtgctgtgcattctatctctagacttatttgttctacataacaataactttgtacctttgaccagaatcttcccattttcctcacttttgtgctctcagtgaccaccattctagtatctatttgtatgtatttgactttttttgatgccacctataatttagatcatacaggatttttctttctgtgcctggcttacttcacctagcatagttcttccagattcttctatattgttgcaaatggtagtatctccttcttttatagagctgaataatatcccattgtgtacacatgtcacaatttatttatccattcatccactgatggacactaggtgatctccatatcttaactatcatgaatactgctgcaatgaacatgtgagtgcagatattcctttgactattgattttattttctttggatatatatccacaagagggattgctgggttgtatggtatctctatttttaattttagggaaccctccatactgttttccataatagctgtaccaataaatattcccaccaacagtatgtaagagctccctttttccacaccctagataacagtcatctcttgtctttttgacagtagccatcctaacaggtgtgatgtgacatctcatcatggtttagatttgcatttgcctgatgatttatgatgttgagcacattttcacatacctattggctatttgtatgtcttctttggaaaactgtctatttaattcagtttctacagttggaaggaaaaccatgtatatagaggaagtaataaagagcaacggaaaggactaatatcttaatatgtagcgtaatttgagattctgaggaattcattagaaaaaagaccaatttttaaaggtatttatttctagacattgcaagttaactagcaagagaaaatatgagagaattttgtcacctatttgaagtgctatttatatactagtttacttaatattgatttcttagcaacattttctataatgtcatagataaataaaggaagagccccatgtttgtacaggaggaagagtttgataatttttcttacacttttgtctatcctttgagaggagtttataacttcagcaacaccttagcagttattattctgaaaagtgacattgataagggtttcaactgagttgaaggaaaaaaaaaacaaaacaaacaaacaatattttctgtatggtcaggaaagatgaattatacatttaactgccatccccttgcttctaaaaatgtagttagagatcatgaaaggtaagagtgtatttatttggccattgatatagagaagcagtcccatttttaagtgtttaaagaaatcacaataaatggtcctgacataagttttgatgtaattagtcttcatgtctgctggggtccccgtaactaaaatgcattctggaaacatcattggctattatgaaatgtgaatttcagtaaggctattcatcaaaagcgtcacatcatatattctattactcttcttaagaataggactgctagatgaagctgtttttatataataacttttagctcactgacagagattgaaaatggtaaatattaaaattctgtggttttacaaactcttcatgaatgattgtcatttatatttagggcaatcttcaaaaagtggctagttcttatgatttcagaaagtgaatgagaaatgttcctccctattctgtatgtaaatattcactctcccccaacatgttcttccttttattattgaaaattgcaagcacacacagaagtagaggtgatagtataagaaactctcatgtatacatcactcagagtcaatagaaggcaactcttatcaatcttgtttaatctatacactaacctacttccacaactccaattatctggaggcaaatcccaaacctcaataatttcacccacaaatatatcagaatgtatctttaaaagattaaggaatcttctttttaatataacataaaaccagttttcttatggtaacaaattattatttctaaattatttagaattcaaatttccataatagtctcataaatatgtaagcttatatgtgtatgcatgttaaataaaaacacatatattttatatgtgaatatatgacatatttatgttgtgtttaatcctcttcaatcatgaaagcaacatttccggacattgtttctcagaagtccttatataccaagatatacttccatttctatgtacgaacactgtatgtatcaagaaatgttacatggattaaaaatattccatactctaccaaatgtaggaaaccttgaattaaataaaattttaaaaataaataaacttacttttaatgacaaaaaccgcaattacttttgcaccaatccaataaataagaattcctttcatttaggaattctcagagcttttaatatgttaaaatgtttaagaaatgataaaagtggagataatatacagaattaattacagttaaccttgggactccatctttctttcttgaagtattactaaccaggaacacttactggatataaatttttcctaaatccacagtattagagaatttcagacaatatattttatatttgaatgtttcttaaatagaaatttcaggttcaagttttaaaaactaagggaacatttgtcaaagcatggtctctggaataactatatcaaaatcaagtggagaagcctgatgaaaggacgtattcaaggtctagacacactgaatcagtatttctggtgcaatatgaggagctcacgttttgaatgcatgctcaggaaactcttacacatgttaaaattttaaaaccactagatcagacttcctacaaatggctaaggaatatgcaagaagaatagcatgacatgaaatgaaagcgaataagtaaccctttgttttgtttgaaaagacttaaagaatctcaaatttttacaaacgatagagtctagcgtagtcaacaactttcctcctttttaatttgttataattcaggccctaaagatctcaccgatccataaataccgagaagtgtttcagtgtcgatgagcctcgagtaactgcagctactctactggcacatatgcactcttaggaagtgagtagaatataggatctgagtggtttgaagaaatctctcagatgcttgagtttcttaagaatttaaggtgtatttgatgaggaattaatggactgaagcccctcttctttccacaaagtagcatgaacagttttgcatatttcaactgtgcaagcaccaatcttccagtccctgcaagtgtgatttttgtctctgtggggtactcatgttagtgctggggctgaggctgcacatggctgtagaatgaactctttgagagagcaatcaatggcctcatggctattagacagccatctgcacaggatgaggacaggtctgcctgtggtgggtggagaggatacagcagttaaaatgttcttgtccaagcacctcttcacccacacaggaggctactcccaggaggaactatgcatcccctttttctggataataagcatgcttatgtagagctacttcttttcaaatacagtctatttttcacactgcagataatggtatgtcatcatatcactcctctgcttcatacttccaaagtttttaactttttcagcaaaaaatgcatttctaaaatttttaattgatgaatagtaattttgttttatgtatttgtgggatataatgtgatattttgatacatgtttacattgtgtaatgattaaatcaagctagttaacacagccatcacttcacatcctatcatttttttgtgatgagaattaaaatcctcattgggtaattttgaaatatgtattacattaactgtagtcaccatgctgtgccgtaggtctctaaaacttattcctcccatctgaaacttagtacgctgtgaacaacatctcctcattccccatccctccctcccaccagcctctgataaccaccatgctactctttactatgctactctctactatgtaagaatatatttcttagcgtgacatccagagctggtttcatggacatacaatccagtcacacagagccctgtgctgaggaagtccccatgtttgaaatattctgctgtgactgtcttgaaattcttaatcattttacctctcaatttgtgttttgtacatactaaacacaaattgagaggtaaaatgattaagaatttatttgtaacctgtgtgtgcatgagctgctgctgctgctgcttcaccatacccacatgcatatgtggcagctcctgcacacacaagttcaggcttaaagacccagcagtcggcatgcgtgcacagcagttggtgtggtgtgcaggtgtgcacatgcttgcctgggtagtcatagtcctggagtcctgagggcatgggcacatcagaacctgggcctcttaaagggatggagataatggtggtagcagccatagaaacggcagtggatggcagcaaaggctgcaggaagcgacttcaaaagtagtcaacaggaggatccaaggtgggaggccagcttgcccatacctcgccggaggctgtctctgtgggatttgcaaaaatattaactctccatcctgagcaccagaacagaaattgttagtgctcaggcaataaactttgtcaataaattattgcaaaaggaaggcatacacatggacattgcaataaaatccacaggcttagaaatagaaattaaacttaaagattattccagtcaatgataagaacattatttttatatgatgctttggggaaaccaataattgatgagttttgctttgtaattgaagatacaaaaatggaatggtaaaacaggcattttgaactatacgaaaatcatgaagtccctttcaatttcttgtacaacctccacaagttacagtgtatgtcagaggaaacattaagattccattgcatacatttatatttaaaattaaattcaggctttcataaaacagatttgtataaagagttaaatctttttagaaaaatattggtgaagagaatcatcagctctagatatttcaacatttatatttcagtgtataattcatcagaaacttctgaatgttactacagtctataaaacagtcttaatggtttcataaaagttgcatcagagaaagatactttgcaaaataaaaacttatcaaaaagtatttgtgatcttgcatttgccaggagtgactgatgtcactgaagttatatcaattgaaaatgaagttgctaaaaatataaattctgttgatctagtaaacaattgaccagaaaagtaatggagaaaattatataatcaatcaagatataacctcaataaagtattatttattatatcgtataaaattatgacaccaaaatcatgtattttgtaatttgtaagtgtatgtcatcactcatctatgaatcataccctaattttattttataagttataaattattttaaagcgaaaagctttgtatttaatacctttaatgacactttttcctctttttcaaaaaagacaccccacgctttcattttgcacttggacccacaaattatgtagctgaccttaatgacgtttgtggcttatatcctgaccaaggctatcctccagcttcatcttcttcgctttcactcctctattactctgtgtttaatcctttcattttcagcacatggttgcacggagtctgccgatcacagttctttttcacacagtttctctgtgaacgctcttgcctgcgcaggaaatctagtttcctctctctacctgctacctttacccagctcactactacttgccttttacttctcagcgaaaacagttctttctccataaactgatcccctcaggatttgccaaacatttcaaacaagtcacttctagtatatggtgcttatcacacattactgtatagtaactaatatgattggattcatgctagcttccttttgtagacgttcatctctgtgaagcaacactccttatctttttgacttgctgcgggtttttttttttttttttcctcattttcttccctatcttgactccagtacttagcataggattggacatacattacatgctcaataaatattagttacaaatgagttaactagtgaaaaatgtaaccattataagtgatgaaataaacatttcttattcataaagctttcatcattattactgtacaacaatgagctatgtagatagggaataatttgtccaactttgccactatgtggtgtcataaatggaaggacttgctgtcatttttaatgtctgaaaattactttaattgcatgatctaaaactttaaatctgggcagttttgctctgtcaacacatccagttagccaacttatcctcctataaatgtaaataagacatttgtgattttttttttcagagtaactacaaaaggaaaatattttctctagttctaaaaaattttcttggatccctggatatcttttttttttttaaggttcaatcacactttattcatttatgtttttaagttttttaggtcatacatttcctcaattcttcatacattttatttcagtcaattaaattacaaaacaatacaagctttttaaattcaaagtctaaagtatataaagtaataatgattccctctctttctcttacccttcaacttcaccttgctaatgtaacaaacttaataatttaatgtgtatctttttttattttctactagtttattctttgattagaatccaataagatccaaaaaaaagaaagaacccaataagatccatacatggcagttggccaagtttttttttaatctattggtttctcctccatctctcttctttttctttctttttttttaattttattattagtatactttaagttttagggtacatgtgcacaacgtgggaattgaacaatgagaacacatggacacaggaaggggaacatcacacaccggggactattgtggagtgtggggagcggggagggatagcattaagagatatacctaatgctaaatgacgagttaatgggtgcagcacaccaacatggatccctggatatcttttacccttattttggttgcaaatctgtgaagaagccttggaattaagaatgggcatagtccacaaaatcattctttaaatttctccttagacaaaattagaatataaagtgcatgcatctggttaggtgcagtgattaacgcctgtaatctcagcacttgggaggccaagtcaggtggatcacttgatgtcaggagtttgagaccacctggccaacatggtgaaactctgtctctgcaaaaatacaaaaatttacctggcatggtggtgcgtgcctgtaatgccagctactcaggaggctgaggcaggagaatctcttgaatctgggaggcggaggttgcaatgagctaagatggcatcactgcactctagcctgggtgacggagcgagactccatctcaaaaataataataacaaaagtaaaaaaaagtacatgcatctaatataaatatggaaagtattttaaataataaaaaatgaagacatatttgatacagaatgagtttgattttctctattatattcatattcagaactatagcgtgtgtttttattttttcatggctcttttgtcagtatgtaccttaaaaccccaaattattacttcctactttctacttctaaatatttatgaatgaagaaaacaattaaaaatgtttaaatggtcaaataataactaaacattctattggtaaaatgcagttacacattaatcattgtgaacatataaatgcaatctcaatgttagtttggtttcttgagcagaatgaagaaggtagaagaaagtgaagattttagtccatttcttagagagctaaactttatcttataaattacccatggagaaatagattctccatgggtcatttcactatttttaaacttcttcatgtataattttttttttacaataacttgcctaaaacctttattcttaaatgtaaatctttcaaaacaatttattcttggtaagatggtacatatctaaatccaaatatttgtccagggccccttcatagatattgagttgctctttgatgaattctcaactctctggaatcagaactttattataaacgaagtagtcataacgatctacattgtgagtctcttttaatctgaacaaatataggactctcaagtacaactggcacaccctgggattgtcctttgaaattttggtcaatgaaatgctaggtcttgtaaaagaaagattgacatagagaacatttctagagggaaggtttttatgatggatgcataattttaacactggaaaatctgaattattaaagggaaaacttccatcttccctattcatgttgcatctttaacaaaaagaaaattagagctacgtcaaagacagaataattatgttgcattcaccctcttaaatataaacgtatgtctaaatctctatagaaactatggtggtcataatcttagaaacatggtttgtctcatggtatatgaagttaacagagagcatttagagctgttaccagtgtgtcaattgtaatgttatgactaaaatgttagaataaaatataacaaaaacaatgcagtgcatcctgtatatatggaatgccattttttgaggtctacagttttctgtaaactattttcatataaggtgtgaatatatttttaattttagtataagtaataagctacaataataaatacaagacatttaaaaacaggcaaaggaatatttcatactggacattgtagaactccaggttgcatttatataatttcaaatgaatgataaagtattcagaaatatgtattttataaccataggctagcatttcataagctttaaaaaataattttttttctcaacagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagtaagttactgaaattgttaagtgcttaataaaatgaatcaagtcttttacatgaatcaccatttttcatagttactctctccatctttatttgcatggataatcactgactgtttttgaagctacatttgtttttgttttggtttattttgtttcgtgtcttccgtagaaatacttgttttctagatgtaattataataagggggataataaaagggtttagatacaagaaatgacaatgatactagtatatcttttaatttcagagttgttttatgtttcgtatttatccagctgtaacaataaagtaggacttgttatatgggcttacgtttttatccatttctccctttctgtctgcaggaatctgttggggatttgatgataaggaatattcagttacatcattcaggaaaatatctctgcacagtacaaacaaccctagaaagtttatctgcagtagccgatatcattgttagaggtaagcataaatggtgaaaaagtgatcacattgtttcttcacagttacagtgttcatatctaaattgtagacctctgagaaaccacaccatgttatggaagtgagatgtaatcagatagagttttattttttaaaccccaggactccatggtatgggtagtgtgaatacagacatggaactgtgtgaatacagacatggaactgtgtaggatttgactatcatgaacggtcacgcttggcaagcggtgtcagtaactaaaacttagacataccttctgtttataataaatcattcttgtcaatccagagtcaaatccacatgctcctgtagttcttcatattagctgcaattacttgagttagattttaagaggaattaaagatgatggttctcaatctttgagtataggttgatatgcaatcatcctatgcctgatattttctaatctccagaggaagcactactacattaatgtcatttaccatgtaaagggaattaatagaactttatcgctaataatgtgctataaatacattatggtcaatattttacttcctaagcacaacaggtaaaaataaaccatcctagtaccaaattaatgaatgtaagtatctccaatggagtcatgataaaacatttttttcaaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacaggtgagtgacaaaagtgttttgggtcactttaaaaataatattttagtccaataattttaataaatgcaattacattttaaattaataattatataattttgtacaattatttgtttttgagtagtcccaacctaggtgccttagtgtctcattctttttagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcaggtaaagaatcaatgtgttctaaaagtgtggaagatttcgtatgatacagttcttaaaacaaaacaagtatttttatgtgtcttctaatacttttggctcaaaattgtttggcagtaaacgagtggctctcattttcttttatttttacatacacaaggcaaggtgtattttctccaaatagtaggttcaataagaaatgattacctttaagccaacatgtcaaaatcagagttcttaggaaactgtgtttgcatcgcatctattttctagtcaaaattcattagagaatctgtagatttgtatatgcaaatgagttactgcttgtttcattaaaatgttgtagccaggaattaactgagactctgttggtgcagtcagccatatattttcatctatttctcaactctgaactagttgtagcttcactgagcagtagtataaatttttttccatgcaaatgaggtaaatcctaagctcatttaacaggggcactaattgagcattaattggttcactgaacagcagaacgcaagaacctggatcagataccatgccttcttaagctcttttcaatggatcctctttgttccactcaaacttttacatccagggtgacatttaatctgctagctgtatatagcccacaaagttcacattcttattcgatcacataaacaaaggatcacttgtcatggctagcttaatttaacaaacacaaattaccttattaaagtgtgcacaattgtcagaagtcaataaatcaatccttaaactaaagataatgttatatgtttatcatagaattggggctagaaaaaggacatacttgacagtgatatcatccaattaaatcacgctagaagcttacagctgagaggaaatccctttgttttacagaagaggaaaatgaacaccaggatattagctggttgtttgtgacagagctaggttttgaatccaaacctcctgatttttacacccagcattctccataaaagaggatcttaatgtagatgagcaatagattagccaaagaaagtgtgtaaatatagaaattccccggccctcctatataccccctggatcagaatcttcaggtgttgtccatgactctggatatgagctttagtttcaggttgtttgtttacagttgatttatattttggtagctttggacagggttgacagaaactcttacattttcatagcaaagtttgtgtgccaccttctaaccattaatactctcttgtttcagtagcagaatgagactggtgatattcatacccactgagtcaaactctactaactgaaaacctactgagtctctcgtctctccctctctgtctctgacatcatcaaagactaacaacttgttctcaatatggttttaggcttaagtacaattaatttaaaattgaatagggaaaggaattttctatttctcagaacattggaaactttgtagaaagtaaatcaaaatataattcaaaatacttttccttacacagctaaactatgcaaagatcctgagatagtgtgcagttagtcactctaagctgtcaagcactataaattcagcaactctgtaaaatccactctgattcacatcgcttttgatcaaaggcattggaagtcttagaaaataaggtttaggttcacataacttctttctaaaaaattatgaagcttaaagctgacaaagttaagggtaaatttaaatacgaaaaggtatatctgaaaggtgcaattttgaaaaagaacaatcagattatcatatgactattttctggtcatgtttatagagctaaacatcagtatgaaatggaaataaataaaataagcaatctagatttatttaggtggtctatatggtggggaaaaatttgaaatgaggaattaaaacttacatattttaatccctgcctaccaatccccagacatatccaagtgcctcctcaaccaaccacctctcctattgttcagacatggtccagtatagacaatttcatgtaattccacatttaaaaagtataccctgctgatttagcgattatcacagatttaggatacttttgtcattacgtcaagaaaaataatgcttttaaacacttacgcatgtgtaaagtaaaacctcattctcgtgaggcactacaataccatatacacactcagcatttcctcagttttacagtttctatgatctattattcattgtgttagtccttacaaggatacagagttgaagggcatagttttttaaaactcatcaaaattactggtttctgaatcctctaccacagagccttagatcccaagaaataaatagaaagaacctctcccagtcgcattcttgacaggagaaaaacctgactttgcaagtgaaaagttagaagaaaatccctcttcttctctcccgagagatttgagattgtaacgaggagttttaaaacaagaatatttatttacatatttttcagtatttaattttaactggtaaaatatcctgatgactaataaaaggaaaaattagtttagtttgtttattgaaaaaaaataattaatatactgcctcagtaacttgtttacagctcaactgtataattaggcactaaatcagcagtgtcactgtcaccatctgaatggaacatcattttgccaattagtagatgatgcataatgatgtcaaatacccgatgttactcaatttttaattaattttggagccagggtgctcatgtatcaaacacaactgtgtcctctctcttagaaatttggatatgtgtaaacataatttacgttcattaaaaatgcaagactctctcacagtatgcctgtgtgagattttgaaaagtgaaattcaaaaacaaaattcttcctgatgaagacgtactttaataattgccatcccacatttctcttggttatttttagtccctgttgtggcaccagtaaacatccatggaggtggaggaagtcggtctgaactcgtcattacgtgggaggtaattttctgtccaactgagttattttgaagaaaagagatttaactggccagaaagaaactgaaaaacaaaaagatttatttgatcactattgagagcgtaaaaaaatatggtataaaaatacatcatcctgatgatgaattatttagaggaggtattaggaacttttctcatggtgagacagtatgacgaactcagcacaattttctcccaaatacacgaaaaacaacttcagtatctattgagcgtgtgtcagtagcattttcgttatcgcttgatgaattaggcattgtttgatttgttacctgtggcactgttgtattgtgaataagttgagcccagtagactgtaggcaaaaaatagttcttgtcctaaccctgctgttcacctctgatcaactcattcttccctgcatctagatgaaagcttaggcacatggagtagattttgtggtcattcttattacccattaacatacaggctcatttttttaccttattaaaaatttcagtctggtgtgtacacttcaaactggagtataaacgttagaatttagactttcaaccaatttaaagtttctcattttcagtatctcagtgcctcagcctaagaattctatagcgtgaaagggaatacgtggtcagttcaacttctctccattctgctctttaatttatctttccccattcacagtgttacctctggattctccagagctgtagaaggttggtgttggtaggggaggagaaaggaaaaggtctggattgctggtacatttctcgtttgactttggtgtgctctagttatggcaaattatcagacgctgccatttcatagggtagggtttctgcgttttttaatttattttttatctgggagatggccactggatgatcccccaccaaggactcccaactgcaattccttggtgcagacccaactggctgctgaagggtatcagttcctggattttggtggtccatttccagactcttccagtgaatattctctctcttgtaggtggtctttgtggatagagtccccttgaaggctgtccatggatgacccacttgcatgggtttcacatttgtcctcagcagacacataccctgctccatgtttagcggaagtgcaatgcatacccacttagcatctctcttcactctgccaccgtgggctgtctggatctcttccccactttaaatttctcagacatttgtcagttaaatgaacctgcgtcccttatgttccaggaaatgcaaaccaggtgtttcttgctgtagcctacttcacatagctaggctatgagagataactgggaaccagagacgttattctttatggttataaatgacagtgtcagaaactagatgcaattgccctgaaagtcaccctttcctctggatatcttgtttcatgtggacattataggcctagcacagtgcttggaaagtggtccaccctccatgaacacttgttgaatggaaggtagtgttttcagagagttggaactctcagaggccagacagagggggaaaccctattttttcaagcatttacaggatttcaggtgccacacagagcatttcatatcattcagtccccacaataatgctataaggtggttataccactttcaagtaagaaaactgagacttagaaaagtgacatcattgggcagagaagcatttgaacacagggttctctctttctgttcttttactgtatcctgtattacaatcccaattgtcttcatgcactgtgatggctgagggtgggcctgagtccttgagtatatctaccttaagtagtaagttaaccatattatacctactactccaaacatatttcccataaaacactgactttcaaatgagtctacaagagaattgtttgtgagtagtttatttaggtttctatattcatcaaaggccaaataagcattatcatcatagtgtacaggaagttttgcctgacttaataacttattttgttctcctccttggtaagaaattcctacaggctgttgttgcaattgcttgtacacagtctataatgagggcccaaatgctatgcattcattcttaaatagagatgagcatgaattaccaaagaatactgtctttccacgatttataatgttcttttttctttaaggcaaaggtacacaaaccatgacctatgagacaaatttgtctagtttcctgttttgataaataaatccacccatagctacatccattaatgtattgatgctttcttgctgttgcatgagaccatatatcccacaatgcttaaaatatttactatctggtagcaacaatagacgctagcgtctgctagagtgacgagaggaagggcgagggttgaaaaactagctatattaatgggtactgtgctcactacctgggtgacgggatccatcataccccaaacctcagcatcacacagtatatccatgcaacaaacttgcacatgtacccccgaatctaaaataaaagttgaattttttttttaagtttactctctggccctctacagaaaaagcatactaacccctatttttaaaaattaaactaaattaaagccacttcctctgtgtttattttttcttcctgaggaggaggtggggggtggatatctgatatgcagatacttgcagaaagtaaattagtgaaatcggtttcccatttatcactcatatttgacattatgtacaagcagatactgagccaacttcttctggtgcccagcttctttatggaataagttatgtatatttaggagaagattcatacattaggatgaatctgagccaccagaatgcaggtagtaattccttcaatttaatgaactctattaggtagcttctctgttcctatcagtggaatacaaaaatggatgagaaaaggtctgaatgctcagaagcgtagaggacagaatggtcttaacccagcctggaaggaggtcaggaaagacaccatcagaactgagtatatctgaactacgttttgaaaagtgacttggaagtagagaggccaccccaggtcaatgtcactcctgttgtagttgaaatagtacctgttggactttgaaaggcactgcgcgacacaagactgttctaagttcagtcacaatctgccattacgtttcataagtgacaactttaatgattatccttcatttaggctccctgtggtataatctgcctgaactgaactaaatatctttcccgtgttttccccagagccacacaataaatgtagattttttgtttatttgttttgatttggtttgtttccaaaaacctagacataatatcaaatttttagaatatagcaatgggtaattcctttttaagggcatgtttatacattattttatcataatgtgtatactcccaaatacttccaggtttgaggtgcttgtggtgaatgtctcataaatattactataaaattaggtacacaggataaagcactatagagtaagagatacatacctacactgagggttggcacgctttttatttaaagggccagacagtaaaaatattcagtctcgtgggccacatgacctcttttctaatgtctcagtctgcttttgtagctcaaaagagccacataccacttacaaacatataggtgtgggtgtgtctcaaaacctttattttcaaaaccaggctgcatgccagatgtggctagaagtacatagttttgctgattcttagtctgtactaaagatttggttcttacagacactgtggttgagaattacattattagtttatcaattttcatagattttactcccaggagaatttcacaatttctttattttactgaacactgtctccacttaaagaaaactctttttctggccttgttaaataactatatatattttttaatcatttgactctctgttgatgtaagaataaagggaagtatctaaataagtctcttttttcccctctaatctgcatatgttggactcaggtctttcttgagagagcaccatgagaaacactaattgtacttgactaacaaaaacaaaactcccctatttatgtagatgaactgactaagcatcgtgattaaatccgagatgaaagaaacttcagaaatgaatcaaatgctctagcaagtagcatcgattcttataaatctcttccatgccattcaaaattaactggtttacttctagtctccctatgaaaaagaagagaagtgttaatatgaggaaatactttgttgtttccccagatgtccggagcagcacttttcttcctcttttcactttctgtatttgttagactgttccacatggcaagaaatagagaccagctcaggtcatctcgggtaatgggggtttattttaaagctacatgggaagtaatgaggacaggaaaaaagtctcagcaagcaggcaggaaggtcagatgaagaaccggaacatggttcatcactgctctgggcactcgggcacaggagctctaggcaaccatcaacaacccctctgctgatccagccccggcttgaatagtctctcatgcttatgcctcagttcctcccatttcctttacttccagttttctacctggctgccagctaatttggatgccctctctctaatttacagcatctgttttctcttagcttctattgcctcactgttcctgctactccatgttctctactttttgcctgctctgtgtatatctatcattgttttgccacccaccatgtttcatatgcaaactctgtgagaggaattgaccaggtctgttagtcaccgtagagtacagagattctgccctcatagatactcaccaagacggtgcctgtggttctggcgctcgtgaattggtgctcgcatgggttccaagtggcaagtagatagtgtgattgatagaataaatggactcccatgaataaagagaacctctgaaatggagttgtggacatgagggactagaagcactgtgtcctgtcaggtgttgcctttattagtctgtcagaatatttattaaaaaaaaaaaagcaaagcattttccttgggaaaaaccaaataaattccattgatttttcaatacaagtttcttgccatcaggagatatgttggtctaaattcaagtacagattcattttaatttgctaagtttatgtgattgtttacaatttttagtatctgcagagtacagggggaatattaccaatttctattttgctattttagtaattttagatttgaaatgtattttatagaatctgatctttgtgagagttaacagtttattctttcatgtgaggaaaaatgcacacatgtcactaccaatgaagatgtatgcctaaaaaaatgatgggaggtcttttatacttttttaaagaaatattctgtgtcttaaagcatatgttatttcacagtaattccattacacatgtcttacaaaaacttgtttaaaatgttgtgaaaggaaaacatatctagtcttgaaataaatagttaagaagttaatttgtgctgagtttaaaaattcatatcaaaccacatttgagtgtgtatcataaaatcttttaaactgttttattattataatttatgaatgatcaaagaaaaatatataaatatgtaaagcttgttttatatttctatctgaaaacttaaactatttatctgagtatctttaactgggatcatttttctaattggcattccaaataaaagtgttttttaatacatcattaaacagaataaatatccatatttgtctctatggaagaaatgtgaaataatcaataaacattatagtagcttaataaaatatttttgcaaatactcagtgattgatcacattctgcccaagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatggtaagttgtcctcaactctggttttctttgagactctatgcatagtttgtgttcccttgttccattttcaatgaaccactctgctaaagatggttatgtctttctctggatggtagaacctcaactggccccaaggggaacttctctccagagtttttctgcttctgaaatggaggtttcatggaatgctattgcctggaatagaaacactggaagagtgctgggctatgaggtaatccacattaatttcacttttgcttatgaatgtgccaatggacttcgcaatagctcctattcaacagtcctatcctactagcctgttgttagcatatgataatgtgtgtctaaagctaaagcagagaatgaagttgagacagggtaggtgagcccccacattgagaggcttagcctgggatgtttcttgtcctcgctcaagacagaattcgagagtgagccagtggtaaaaaaacaaaaacaaaaacaaaaacaaaaaaaaacagctttattgaggcagcagtgttacagttttgaaattgcttctgcagagcagggctaccccataggcagtgtgctaagagcagcagcttggaagcagttctacactcatatttatacccacttctaattacatgcaaattaatgggtgagttagttattcagaaatttctagaaaaagggtggtaacctccaggccattgccatagaaagggatggtaacttccaggtgttgccatggcagtggtaaactgatacggaactggtggttgtgtcttatggagaggtgctttagcctcttccctgtttcagtcagtcttcaatctggtccacagtaaagtcctgcctcctccctcaaagtaagggaaatctttctaggtaattcaaagcaaacaaattaacacatagtagccatttttaaaggcatacagattcagtaagtaagatgagtaagctctaaagatctgctgtacaactgtgcacacagagtcaacaattatgcattgtacccttaaaatttttcaagaggacagatctcatattaagtgttcttaccacaacatcatttttcaaaagtgatcaggtgattatatgattaattattcaaattgcagtcatttttttttcccttggtaagaggtgaagtctgctcctcaatcatcttacaccatggaagaatttcattgagaaacctgctttgtgaattgcagtataacttggaaagatgtaatcatctcagaaaaggcagttaagtaatgaaaaaaaatacctagattgtcttgaatctgctatttttagtctatgaagaataaggcaaattacatttgtaggccttcatctcacaaagtaaagagacaagaacattttaagggaaagttgttcatcactcaatctttttcaacttgcaaattcagtgattcacaaaatgggtaacataatttatttaactttggatttagaataaatgtataatcctaaacattcttaattttgcctatatatatatatatatatatacacacacacacacgtatacatatacatactatatatacacacatatatatacatatatacacatatatatacatatatatacacatatatatatatatatatatatatacacacacacacacacatatatatatatatatataaccataatcctctgattccaacagaaagttctactctcaggacaggtgtcttttccactccatgccaagaatgccttacctcttatctgaaccctagttacttctcaaatttcatccctagtcgcctcttctctctgagctctactcccatcaattcctgatgtattttgtcaaattcttgtagcatattttttctataccacttctttgcaatgcattctgtgacttattttcacatacactgtggattctaacctcttagctagatgataaggggcttgaaaataggtacttaatttattctctttttttttcaatgtacctaaaacaatgctaatgcaaaggtagggttcagtataaattgaattattaattaacctgtgattcaaataactctgaaaagaaatgccaatagcaagacattataatgaaagtctttgactgattatatacaaatgtgtttttgtctgacttgttatacatcatttgctaaagctggtaacctttagatagctcataaaatactttattttggtaatctaaaaaatcacgttctctaatttccattgtgaatttgcattcatgacttttttcctcataaatattagagaataacaattttgttgttgtataaccattttaattagaaaacgtttttgtcatctatacttctgtcttcttcccatattccttgtggttgtggttgatagttgttggtaaaaaatgattgatagttattggggaacaataaattgcttgttttggtttttaattatcaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcgtaagtatgcatacactccaggaaacaagattcatctgtgaagagcaacctattcctttgcttgatgttcatttcattcccacacctcatttctttactaattggttactttggttagttggtttgtcccttaaatatggatacttgttgaaaccttttggtaacaatcaaggtaattgttttcatatttctggaattccaaaagaggaatattccaagtatatcgatgaaagacagaagagcataatgtttaagactggccctgacgccctccttctaaatgcattcaaaaactgacctcctatccttggaacgttaggtggtatttatctttgagtctcagttgcctacctataaaatgaggaaaaagtcatatttatgttttcataggttttgttcaagattgaaagagattattaataataagtgtccagtacacaccttaatatatgctcagtaaatggtttttttgttttgtcatttgagtccgagtatattcacatgtgatcctacaactgtcagacacctagatctttccttttaggataccttattactacagcttacttggaagtccctgaaatctaagaatgaactcttctgttttgtcttatatcccctgataatcagccaggtgatttcacagaatcagaatctgctacataaaagatgaatgtttttcatcttttggtgattgttgctgcctttattttctgactgagtctggtaatgcacaaatattccataatacgaggcacagcaataaattgggaaaggtctgatcatccgacttagttgttcctgtaagatgatttttttgtggttgaataatatttacatattccttatatattattaatgaacacaaattattcataaaatcagactttttaaaacacatttttttgctctctgaatcctgatgaatgaaagataacaaatatagttgctgaattttgagaaagactaagacaaattcagtgccacttacaaaaatctagtttacctatacatgccgtagtctaattacaccaccatatttggaaagaagagatggttaagaagagtttgaaaataaagttatattaaagttattccccttatgcgtatatatgcgtatatttgtcatgtccaaaagaagttagttaggaaccatctcagagaataggcccttgattaaatagattatccagttatttccacacaaccagatcaactgtcagatattcatgttccaattctgggtacatcattgactcacaacttgaaataggacaaggcattccatttttttgctttcatgttcttatctatttattaaatagaaattatctctgtcctcactccttcccaaattacccatgaagcacaaacaaggtactgattctggaagcatcttagaaaatacaaagtgctgtggaactgcaaaagcctgtggagcaaaaatttttgaaccaaatttcctccagtccacccagttttagacaggctgggctgtgagttattttcaagaatggattagttaacaatgaagttctattccttttcctgttttactcaatgttgactaaatcaatgaagttgttgccagataacttggatgtatgatttgcttctttggtcttcctggagtggtttagcttctttcagctaatctgcaaatccgaatgaaaatctccaatcaatcagcagttttcagattacctagacatttagttctagttgactgagagatgccaaactcacagaaactcttgtgtgtagggggaggagccaagatggccgaataggaacagctccggtctacagctcccagtgaagacgcgtgatttctgcatttccatctgaggtacccggttcatctcactagggggtgccagacagtgggcgcaggtcagtgggtgagcgcaccgtgcgcaagccgaagcagggcgaggcattgcctcacttgggaagcgcaaggggtcagggagttccctttccaagtcaaagaaaggggtgacggacgcacctggaaaattgggtcactcccacccgaatattgcgcttttcggaccagcttaaaaaacggcgcaccacgagattatatcctgcacccggctcggagggtcctacgcccacggaatctcgctgattgctagcacagcagtctgagatcaaactgcaaggcggcagcgaggctgggggaggggcgcccgccattggccaggcttgattaggtaaacaaagcagccaggaagctccaactgggtggagcccaccacagctcaaggaggcctgcctgcaactgtaggctccacctctcggggcagggcacagacaaacaaaaagacagcagtaacgtctgcagagttaaatgtccctgtctgacagctttgaagagagcactggttctcccagcatgcagctggagatctgagaactggcacactgcctcctcaagtgggtccctgacccctgacccccgagcagcctaactgggaggcaccccccagcaggggcacactgacacctcacacggcagggtatgccaacagacctgaagctgagggtcctgtctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctaaaacgcagagcgcctctcctcctccaagggaacgcagttcctcaccagcaacggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatatagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcaagaagggaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaacggcagccagagagaaaggtcgggttaccctcaaagggaagcccatcagactaacagcagatctctcggcagaatctctacaagccagaagagagtgggggccaatattcaacattcttaaagaaaacaatttcaacccagaatttcatatccagccaaactaagcttcataagtgaaggagaaataaaatactttacagacaagcaaatgctgagagattttgtcaccaccaggcctgccctaaaagtgctcctgaaggaagcactaaacatggaaaggaacaaccggtaccagccgctgcaaaatcatgccaaaatgtaaagaccatcaagactaggaagaaactgcatcaactaacgagcaaaatcaccagctaacatcataatatgacaggatcaaattcacacataacaatattaactttaaatgtaaatggactaaatgctctaattaaaagacacagactggcaaattggataaacagtcaagacccatcagtgtgctgtattcaggaaacccatctcacgtgcagagacacacataggctcaaaaggatggaggaagatctactgagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatctatgcacccaatacaggagcacccagattcataaagcaagtcctgagtgacctacaaagagacttagactcccacacattaataatgggagactttaacaacccactgtcaacattagacagatcaatgagacagaaagtcaacaaggatacccaggaattgaactcagctctgcaccaagtggacctaatagacatctacagaactctccaccacaaatcaacagaatatagatttttttcagcaccacaccacacctattccaaaattgaccacatacttggaagtaaagctctcctcagcaaatgtaaaaggacagagattataacaaactatctctcaggccacagtgcaatcaaactagaactcaagattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctggcagaaagaaagaaataactaaaatcagagcacaactgaaggaaatagagacacaaaaaacccttaaaaaattaatgaatccaggagctggttttttgaaaggatcaacaaaattgatagaccgctagcaagactaataaagaaaaagagaagaatcaaatagacacaataaaaaatgataaaggggatatcaccaccaatcccacagaaatacaaactaccatcagagaatactacaaacacctctatgcaaagaaactagaaaatctagaagaaatggataaattcctcgacacatacactctcccaagactaaaccaggaagaagttgaatctctgaatagaccaataacaggagctgaaattgtggcaataatcaatagtttaccaaccaaaaagtccaggaccagatggattcacagccgaattctaccagaggtacaaggaggaactggtaccattccttctgaaactattccaatcaatagaaaaagagggaatcctccctaactcattttaggaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacataattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgagatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagccaccaatgactttcttcacagaattggaaaaaactactttaaagttcatatggaaccaaaaaagagcccgcatcgccaagtcaattctaagccaaaagaacaaagctggaggcatcacactacctgacttcaaactatactacaaggctacagtaaccaaaacagcatggtactggtaccaaaacagagatctagatcaatggaacagaacagagccctcagaaataacgccgcatatctacagctatctgatctttgacaaacctgagaaaaacaagcaatggggaaaggattccctatttaataaatggtgctgggaaaactggctacccatatgtagaaagctgaaactggatcccttccttacaccttatacaaaaatcaattcaagatggattaaagacttaaatgttagacctaaaaccataaaaaccctaaaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatcaagaatctacaatgaactcaaacaaatttacaagaaaaaaacaaacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtgaggtggggggaggggggagggatagcattgggagatatacctaatgctagatgacgagttagtgggtgcagcgcaccagcatggcacatgtatacatatgtaactaacctgcacgttgtgcacatgtaccctaaaacttaaagaagtaaaaaaaaaaaaaaaaaaagaaactcttgtgtgtaattcagtttctatctcaagcaaaatcaagagtgattagaaatgtgtaagaaacaaacattaaaaaaaaaaacacattgtatcatggtagactgacagacattttagtgcagttattgagccaagactcaggtcaacttttattatacataatcccatcaaccagtttaaggtggattgaaacttgaacactgaactaatcatttacctcaggaagagagagatatatccatatgacatatataatacctatacatgttttaaaattcttattgagattttctgtatgatatatacatatatatattcacatctcactactaattttatataaatatataaaagtgagtagccccacactcccttgacctcaagggcagtctttgaagcaccttcttccctgctattcttaagcactgggtggatctgattgcccagatagggcactgcctttccccaaggtcacacagcaatgaagggggacagatggaggagagggggcctagatgtgcaggcagccccacacggtctcattggagtactgagaggcccaggcctcagctacataggagaactgctccttgctgctgggccagtaggtgccctccgtctgcctcatctccggaagcttccgcaccaatagtgccagccccactgccaggaacaagacagccaggaatcagaggaccaagatgatagcagtgacggccccccgaaacagggctccactggagctggagctggtgggtgtaggccaaacaatgctactctcatttgcagaaggggttgatatttgcgcccagggtcgttcccagggacgacagcagcggcaggcccagcgccaggagtagccccaggccgagctgggtgacgggttgacagtgccgaggaaggggcttctggcgcgcgcccctcctacagcatacagggcgggccatgggcacctgcaacggggcacctgacccaggtgtctttgaagtcgctctgtatatattctatatatatatatcagaacatctcagtaataattttttctgtcatctgaatttgctagtttcattgtccatgaaacctaaattaaaagtgttagtttgtgctaaattattctatgtttttaagcagaaacaaatccttgtttttgacactaaattttttcagttgacccaattgatcctacaaatgggttggacagaaattcacatcaaatgctaaagattattggtttgtctgatggttaacgtatgatcaatttgtcaaagagtaggagataaaaattttcgaaaacagttaaattaaccatgagtaatttcacccaagacacaacgttagaatacctctgctaaggaaaaagtgaaataataatcagaaattctaaactgaagattagcgttcctttaagtattcagctttcttaactaaatcaaacaagaaaaacctctgtaattcctagatatctagtttcaatagctcttaaatttgactcttaccagcctgtatgcttcagtgaccctataaaaatagccaacaagcacctgagaataagaagaatatacaagtctccatccctttgcatttaaatacctatccaacctctcattttattactttgacattctacatcacagacattgtgaaagcagaagagtaacttttctattattctattaatggccttaaactcagtgttttaaaacaatataagttgcttatcacacatttttggaggtcaggagttagacaggggtttcactgggtagaaatccagatgtgctcaagggctgcactagctttggaagctccaaaggataatttgtttcctgttttctggcttttggagaccacccatatccctggcttgtgaccctccttaggtttgtgaccccttcctccatgttcaatgccagcaacagtagggtaccttcacatctctgcctctgaccctctgcttctgtcatcacaactcctctaactctcactttcttgcttccctctttcccttgtacggaccctcctgatgacattggagccacctgaatcatccaagattatttcctcatctccagactcttaatcacatttgcaaactccttttccatataaagtaatgtgtccacaggtactggagattaggatgtgatcatgttttgggggatccttattttgcttaccacagtttcaaattattgagcacttctatgtccccagccctgtattaactttatcatactaaatctcacttaattattacaataagtcaaggagtttggtattttaatttctagataggaggacacaaatgcttagaaaggttttgtcatggcctctgttagactgatgagcatgaaatctcttcatcccactaccactgtgctcctttatcaccttcctccctaaccatcccaataatttctctccctgactgtcaaatcctccatctaaacctcaaactgctttgaaatttttcctcctaaaatgccgtcatacttctcttctcttcatcaaatgtcattgtctcctctattccagagaatgtagactaagaaaaaggcaagcaagatctttcacaatgtgtctcaaagctcctttctataacattcctcttctagccctgacatctcaaacttactgatcttctaaagtttaacattcacttacctggcttcatgaaatctctcagcttgtagtacccctgccaggcctatatatggtcaaatggtcttttttctgctctatagcttcccccaaaatttcccctttaatgtatttgcgtttttctaagaattccaataactttggcccattgtgaaacagtgttggaaaaagttggaatgggacttcagagagaattgtggatatggatccctgctcagccatgtactatctgtgtgccagatctaattatttgataactctgaatgcattttctcatctgaaaaatagagatgaagatacttacctctagcgatttctctgagaaccaaaggatataatgtacaccaaggtgacccagaggctgtcatacatcaaggctcagtgcctggtaacatgtgttattatactcctcctttagaggcaatttactttctttgcattttttaaagtaagaaaccacagctactttctttcactttataagtttgttgcagaattttcttttctttaagggtcgtagaaggacatccaaagcatgcatgaaaaacagctttactgaaacattgatgataaccatgattccaggtgctattcctgtatgtaactttgactctccatgtccttgagatgacatcaagattacctctcaatagtggtgactgaaaaaattctgcattcagcactgtcactgtctagatttgtaatctgatatttgatcttccattggaaagtctgaaaaagcagagctcacatttaccaaaatctctgcctgttctaattggctaagctaaagagaagacagaggtattttctttgtttgtttgttttctcacatgatcatccagtcatctactcaagagatagtgcctcccatgagccatgcctagagttagatgctgagggcctaagagcaattaaaccaagcaagatctttgccaaccggcaatttctcttttagagaagaggcaacctaaaacaagaaaaaaagacaaatgaataaaataatcataaattatgaaaagaacagtgaagaaaataaatgagaaactaagatgtacataaggagcatctatatgggataggctatgtattttgatacaaaattaaagataaagaggagttaaaggacaaaagaacttccagacagaaggaacagcatatgccaaacttcttaagtattattgttgctgttgatgatgatgatactagtattattaaacaaatatcagtgattcatctgcaagtaccaaagcctagtggaaatgatggatttccaaaagaaacagaggtactgcaaatatactgtgatccacacagacattacttaaatggaatttagatttacaaggaaagaaagaaaaatatttatgtcaattccaagcagaaaagaaaagtgaaacaaacaaaacactacttatgtggaaagaagtattcagacgcaataactaaaagtgtttgcaaatgttggctcaatttggcccttgacgttgactgactagcactttgtactcgattctttcttgctgcaaatatgcaatcaatccatatttaaacataaaggaagcattaagcttttattttatcttgcacttatgttctttctcttctgcccaaatgtcaaccccatgctgttacttagaggtgtaacataagaagttgtttttgaattgagttcacagtgtgaactacagttgaaaagaaatgccatctacagaaaaattgattacagggaaaccattagaattctgaggggctagtttaatgttgctctgtcatttgattaatagaaaatgatttagtctttggaaattgcctggaaagattttaaaagttagaaaagtgcttgtttgctgagtttaccattgacagacttggtacaaatatcatgacatgtgttttgtgctatccatgtggcagtgttttggtttctcaagatgatagaaattttaattttatcatagatatttgcaatccagtttaatcaactatatcaaaccagaactgttaacagtactcacattaaggtgatggccttctaaagcagctttcagaagttttatttgtcaatatcagacataaaggattgacactggagaaacatccattgataaaaataagaaaggatgtagactaagagatattctaagataattagctgagactctcccattttatctccctttctaaaaacatatcaagcatccaagtaagagcaatattattaaggggaaaacttgaatgtacactaattgtatctaagaagtgaatcatttgcaaacttcagagttggattattagcaacaaaccacttcgaacacaactgaaaaattgattatgtcataacaccacagtggagaactgctactcttggaagagaattaacagttacagggctttttaatatataccactaaccaaatgaggaatatttcatattttatttcatatctcataaattaggagttattcgtttcattttataatgggaaaatccggctcttggaagagattggatacaaattcaagtctctctgacatcaaagcccaactcttctcatctcccagagagcaagagaagtaaaacattctaaataatctgtataattggctattcataccaaggtactcactccgaatgcaactcttctcgttttatgcccacagaaagttgtgcttctgctttggtagatgaggacacaaatgcaaacatgtcaatgacaaagtcattgccaacattgcaaactgctcctttacatagctggaagaaatcaattctgtctcctagccagttgattttttcaatggatttatagtgttgaaaacaatactttttcctaaaacaaacaaaacatccggaaatacataaaacattcagaatccacactgccaatgacactgaagtggtgaatttgtattttctctgtattgattatataatggtaatgttagtgctgaattttaaagaacagagataaaaagaaaggtatcaagagtagactagatattaaaattgcaatatcctgtgagaattttgatattatatcttttatagctgagaaaaagattttaaaaggcactggaggataagttgaggaaggatagttacaaaataattcttgctgccattcagacctttagaaataaatatgttgataagcattataaatgacaagtacgttgtacattgacaagcaaagtaatggatgcttagtaagctaaaagctttcaggcctttaattatgggtttatattgtcaagaaatgtaccaggacatggtcaatccaattggcctgtccatcttataaataggtatggattgctatgagtctgaccacggcaattggtcttgatcataggacaacataatgaatggattggctgtattgtgtcacctatggatctgcccagagcccagtgcataatcaatacagcctgagaagatcaccacagggccctgaacagttttccttagccaccttattgtacagtcatttattcaacgtgtatgaattggatgtctcctatgtgccaggcactgtgctaggggttagtaatacagagttgagtaaggcacttgccctcaagaaatttaaacaaacacataaccaagaataaatgtaaaccaatgtgataaacctataataaaatatgaactaagcctcatgtaagcatacagggaaacatttctctatcacatcccaactggactgtaagtgattgagtgaacaatagtgatatcccagtggaagtggggtggaaagagaatgtatggtaatatatttgagacacctggattcagcaatatgtgaatcttccagtgacacacaggagattaaacagcagttgactcaaaactatgaaagaaatagtttccacttctaccagtgttataatgaattaaatattatgctcactcagcctcacaaattcaaaagagatgccaaaaacatcttgttgggcagttttatctttacttccactttccagatgaattattttatatctctccagtttcaatctcaaaaatagtcatgtggactcagataagcagcaagttgttctgcagaaacactagactgaaagcgctagaccaagattcgtcagctgcatgcttttggataagtgacttcccaacctggattctcgttttcttgtatgtaaaattctctagttggactatatccattactttagaagccagattctaaatctttcatctcttatctcccaccatctctcacgcagacaacattaatttcagaaaactaaaagtcgcagtttggatttaaagttgatgtcctttgggatgatcaatcagtttgtgatgattttccccttttctggcttcccaaaagctccatttattttaaacggcatgcatctttcacattgtccagacacagttgattaagctaagatagacatacgaccaaatgaagtcaatcatcagctttctcaggggaactcaaacttggactatctctgaacagaggaggttttaagtttcaggtgtggtgaacagtcatgatttctgccgtgtgcagtgagaatgacaaagaggtactctctggcaagatgagtatacagcagaccctgcttcaataagcagagtgaagactgtggctttgtgacatttttttctctcctcagactctgctgcaatctgccatgacttataagaaatatccttgataatttactacaaatattttgcttaaaatatcttgagttagttgtgttacagttagaaagctaactaatacaatgttaaaaagtaaagaattttaggaatgaacatctatgtgttgatatatataaaatgtttgcaacttgaatttgccaaacatgctcattgattgatggccaaatggaatcctagataaagagaccctctgtctgtttatatatgataaagtaaacaaactcaacagcaatgattaataaattaatactggacatgcagcaagccattattaattcataagtctgtcacaaaggcattcccaaatgaccagatttgaataaatttgcttactgtgattagaattaatatatttcaaatgacactgaagacattttagctccttctatgcaaatcatcgaagacttattttttcttttcatgttgatgcatcatactttgaccatgagctaattaacattcatttggatctttgattatctctttaaagctccaagccaaccaccagcaaacattgcctggaagctgacaaactctaaattatgcttgaactgggagcatgtaaaaaccatggaaaatgagtctgaagttttggggtacaaggtgagtttttagtttttcctttaatcatatcaattaagttactaaggaatgaaacatgtgacacccaaatggaaaacaaattggatgcatatggaaacactggaatctttttcaaaattattttgaaaataccattgctgctttctaattttccattgaaaatgttttacattccaaggtccagtaatgtattagggaacatcaataaatcaaattccataggatgtaacattttttcttcaagtggcatcccttgctatcataagatgatggcttatgtgcatagtagatgtgatgacaatgagatcaaaaaatatatctaaatagagattttagaacttaggctgcagtatgatgtgatcttttaacaacataaaaggcatctaacaagagtacaatcaagtacccagagcaactcatttccatcagtgacaatggacatcatctcttggcagacatatattcaacatttgaaatgggtccaaactcaacagtgactttccacagcaagctccaatgataatagcctcaagctatttaactaatagggataaatctactctccttccagaggcattggccaaaaaaaaaaacacctctttttcttaacaggagcaatggaatataaggaaaagacatcacttggatatttccatctgaggagtacaacatttatgatgatgtatcttatgtcttacagtgttccagaacagttgtgtgaaccttagaaaagcaacatgtccatgttaacttgatacctcattttattcagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtaagttgagtcaccattgctgtagtagattctgaacctagacagctgcagcatgaaattcagctccatgaaaccttccagttatggcttaaatgttgggtgataagataaattttcaattgtgagcaaaaggtgatgagccatttttttaagttattctccaaaattataacatacactataaatggttttatgcttcctcatttgaaaaccaaaaagagaacaggaaaaaaaatctttgtgtcattagagcataattgtatcactcattctattatcacaaaaatcagaaagatttttcatagattctttcgggtcttttacaacaggaatggcaaatatgaagcacaggtaaatatacaccctttcccatgttcatggcagacatcactaatcaagtgtggctttcataaggagctgagtcacaactttcaagtcctcctcaaaacaattttctaagccaaccaacaccagtcagtcagagttagcaggcaataataatgtatcatttttgcattagaaaaatcacttactcatctgcctgaagctgtgattgagtgcaagtcattagcatccaatgttggccaatcctttaggcagactttgccaatttagggattttccttttgcatttttatacttaaatcagatgtccttggacaaagacacggtaaggcactttctaaaattaaatataatgtgaatgagacaagtataataaaatatgttactagaagagaaatgatagtatgaaattggggttttgaaaaattaatctaacaggcaatactttatctcaaaatatttttgtcttatttttatattttgcaggtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaacacttttgaattttaaaatccgcacatgattacatgaattcctaggtgccacattaacctggggagttgtaactgctgtgtcttttaagttacttatatggagaaaataaataactcccctcaatgatgctgatgatgaatacaaacttggctcctagttaccataactcacatgtacatttttatgtattccagacaatcacttcagtatttaaaatttccaccctacttcaaaataaaatacaattatttgtttatagttgggattctttaaaaatacaaactattccaaagcatggggtgcttttatctctgaatcaagttggaataagaaatctttttactcaagaatatttcaatatacatgatgttcttctcagcccacttttcagaagattcagtcacaataaaggcagaaaaagtattttatggcaaagaaaaataaatgatgggaaatgagcacccacctaaaataatcttctaacaactctggtatatattaagcaattgctcatggcaaagttgaacatttgaactgctgcatgaacaaatctcaggtaattatgacaagttgattgcaatgtatgtggccttatttttataataaaacaatgtggaaacagaattatttgatcaagttttctacactttggtcaaaatattattttttgccaatcttctctgcagctatgaaaacaattctacatgaaccagggtttagaaagattgtgtgggttgacttttctctagggtgagcctgtttcagtcagtgacctcacttcttaggattgtgtagtctggagaaagcagtctgggagaaggtgagattagtgacctggcccatagaatgctatgtaaccaccccccttcctccacaaacagccttgagaggtcagttcctgctgtcagccttctctggctcccagccagtcaggtttgttgtcctttagagctaaatgtgagaaatgctcacgtgacttttatcttcttaacatggtgcaacctcttaattatgttgagaatatttgagctattctcacaaccctcaaatcatacaatcctcaatatgggattttgtcatttgcatgtctgaggtattttagaactctttaaaataccccatgtagtcagcagcagatgaacaatggctttcatagttcagaacttgctccttgcctgaacagtgtgtcaagcacacaatgcaaattaatgagccttattctccccattgccatatgatctgactgtgcttttgtagagcaaaacaaataagcaacaacaaatactatttggcacacccgtgttaacagctgcctggccaagatacatctgaattgaccagagataccagtgctggcacatggtcttaatggtttccttaatttggtaagagacaagatttgtgtcctcctccccaaagaagacattgagggttaaaaatactgtgaggtttttgtttctactaattaagtgaatcagatatacagtcatttgtgtgtgagttcaaaagctaagttagtttttatcaataattcttatatgtttgcagagtactatttagttcatgatttctggaatattaaatgtctgtattcactgtctaacatatctaacatattatttatcttttcatcagttcactaaatttttcagaatatactttggcattaataataagcagcatgggctttggtgcgataggaatctctcctcttagtgaaaacttggacatatttcttttaacatctccatttcactaatatcagaacaatagagtgttatgtacataaggtatttggcatggtgcaaggaacattgtaagttgtcaataaatggagctgctgttatctgctgctatgaattaaatcccaaatgacataagttattacgtttacatatccaatatattatgaaaatagtttcaacctgtgtttatgtcaaaatccaaaccagcttcaagaaaaatgaattgatcacctactctccatactacatggcactcaaggatgaaaacagtggtgattctaataacctgtttcagggaaatgttctacatgatgtgtatactcctctgacattcaagaaggatttccagtgcatccctgtattgactgagtagactgctgttataaacatgatatgtcatttccatacttcctacaaaaaagggagataatgtgattgtacctggaaatggctggagaaggaaccagaaataaggtttaggagactcaacacagtggaaataccactttaaagctatggactgcctagatcgtgtagagttcaaacacagcttcatttttttctcttttgttcacactctaatcctccatgctcagtgtctcttttctatctatacagcagggggtgaggagggcatggctgctgtctttaaaaacaaatgcagatggtgagggatgacctggaacctatatggattctaaatgtaataacataattattacttctcataagtaaatctagtatttttatacttctatgtatgtcagtcttgagatgcaacatggagtacacactcctgtattagtccattttcatactgctatgaagaaatacctgagattgggtaatttataaagaaaaagaggtttaatggactcacagcaccacatgactgggaaggcctcataatcatggtgaaaggtgaaggaggagcaaagacacatcatacatggcagcaggcaagagagtgtgtatagggaaactaccctttataataccatcagatctcatgagacttattcactatcatgagaacagaaaaaaaaaaaaccacccccatgattcaattacctcccaccaggtccctcccatgacatgtggggattaggattatgagagctacaagtcaaaatgagattttggtgggaacacagccaaaccacatcaactccctgtgtacaattattacttaatgtgctatagaactacatattgaattcaggagatattttgttctagacaatcacatctttgttgaggtcaatacttgcattaggattctccagagaaacagagccaatagggtgtgtgtgtgtgtgtgtgtgtgtgtgtgtgtttgtggagagagaaagaaatatattacaaggaactgactcatgtgattatggagactgagaagtccaaatgcaagagagcctttgatacagttccagactgagctgaaggctaagaaccaggagggccaatagtgtaaattccagtcggagtccaaatccaaaggcaggatgaaacttacttataatctagctcaaagacaatcaggcaaagaagaataattgtttcttactcaggcttcttgtctattcaggccttcaccagattggatgatgcccacctgcaatgaggagtacaatctgccctactccatctaccaattaaatgtattaatctcatccgcaaaatccatcacagacacagctagaatgtgtaatcaaatatctgggcaccaaatggcccagtggagctgacacataaaattaactatcacagtattctttgggctgatattaaataattcaattctgctttcatcagcttttggaatgaaattatttaaatgctcctctcaatttattcatttgtaaaatcatatgttgggatgacaagatctcagagttcttttaaaactctataattttgtactaatgtgcataatgtgtgacttctttgggtataagacagtatttcagaaaccttcacaacccacacatactctacagtcctttccctttttttcccctgtgtttttaccagtcgttccgtgccttttaaactggagtttacattactaaaattgagcatgctttttcaaactacaaaagaccctcagagtttctaacccgtctctgcactccattgagaatcactggtgtattgcagtggttcccaagggcaggactataatgaagttttcactgttcagtgaaaaaaataagaaaaacatgtagagtttggtgagctattcataatgaataatttgtgaaatatggctttcctgcactgtgaaatgctcattctttggggaaacaaagttgagaatggatcacagtttgttttacctgctctgttttaaaataatttacttgggaaaagagtagattactttatatcaagttcaattatttttattattaaaaatgtttatcttctaaggaaaatgaaaagttgaaaaccactggtgttgtcatctttttaatatttctttaatctcataaccattaaattagcaatttgactttgtgtgttgaactgtagtttatatgccaaaacaccaaggttctgagttctatagaattattgtttacttatataaatatttatatttacttataaatttacttatatgaatattaatttacttatataattatattaatttacttattaatttacttatataaattacttatatacatttacttatataaatctaggaaatatggcctaccacttataacaaaacatgaatataattagattgcaagaaaaatagaatgtcaaaatcctgacttttttaatatcttaaaatatggaaattatttgctttccacttttctatgttaaaaattatttcatgaaattaaatatagttagctgttaggctttctttaatgtatttacaaatgattttagcaaaataattttattttagcaaaataatttttattgaaagatacatttatttcttcagtttttttcaaatattattgttcttaacagtgcttggtgtggtcctgggcagagaatgatgcttaaaacatgtatttgctttctggactgatttatacagccaactgttggcaatttgttttcccttggtttccttaataaaataagggccaggcaaggtggcttatgcttgtaaactcccagtagtttgggaggccaaggctggtggatcacctgaggtcaagagtttgggaccagcctgaccaacatggtgaaactccatctctactaaaaatacaaattattagccaggcgtggtgcacatgcctgtaatcccaactactctggaggctgaggcaggagaatcgcttgaacccgggaggaggaggttgcagtgagctgagatcgtgcctaaactccggattttggtgggtaaataatatatctctgaaataaataaaataaataaaaataaaatccttcgaatattgtcatttgaaaaaacatcagaaatgctggtatgttgctattttaaaacacatactttaaaatctagttagatgtgccttagaagatccttattttgtttggagtaaagctctggaggaaagctcacgcgatgactctttaaataaagatagcaagttgcagctcaatgagagtgaaaagaaatcttgatgtaaagtgttttgttccctacacccattaaagagaaggagtaagctaggctaaaatgtttgtgggtatatcatgttattcctggaactgaatgctctgttggatagaatcctattcttaagcagtgattaattaatgtttataaatcacttcaaagatggaaagcattgtataaagtctaatcatttctattatagtgatttttttccaagaagtatattgactttttgcaatagcagtttgaaaaagcatgcatttgtgactgaggccaggtatcatgcctggaggaaaatagtaattggaaagtttgaaaggtaataattctgagatactgaaaatttaggtgaatttataatagcagactattataaattagtccagtctgcatggactaaataattttaattcaaacgtgaagtaatctacatctattcatgacagttttcagcctgtgaaataaatgtcatagcaacagactgtgttcctgaaatgatatatacctgtaacaaacctcaggtaatctcaggggctttcatagtaacaataatgagtttagggaacttttattacctgtaactgcagtagttataaaaccccccaaaactaaaactaacttggaacagattcattttagcctatttttgttgacagaaagcgtaattagatatattactggccttttttccttatctgtgtaaaagtgaaaatgttgtaatttaggcatcaaaattactgttgtatttagacttgcaaacatactgagatattttcatcttctaaattcttaaaagaatagagtctatatatatatatatatatatatatatatatatatatatatatatatttttttttttttttttttttttttttttttgagacagagtcttcctctgtcacccaggctggagttcagtggcatggtctcggctcactgcaacctgtgcctcccaggatcaaggaattctcctgcctcagcctccccagtagctgagattacaggcacgcaccaccacgcccagctaatttttgtatttttttagtagagatggggtttcactatgctagctaggctggtctcaaacttctgacctcaggtaatctactcatctcagccttccaagtgctgggattacagatgtgagccaccgcccctggccgagtctacaattttctaaaagagattcctaagtccgaggacatggctcaggttattttgagtaatgtttggactcacataatatttcaaactagatgacagttgaaaaaagactgtaactagttaaggaaaatctgaaaacccacaacttgttggtgtcaataggtagacagtactcgagaggctgaggctggaagatgactggatctcaggagttcaaggctgcagtgagctatgatcacgccactgcacgccagcctgggcaacagagcaagactatgtctcaaagaaaaaattgacagaatggaaattaatattcatttaatatctgttgataacaactaagataccagatttttctacctgaaattgatattcttcatcagaaaacttcatgccttgtattatatcatgttacattaggttgccttacaccatattttattatttaattatcatatgtctcattttgttttagaaaatgaataatgagttccagaggcgatggaccttatctttgcatttccccttgcatccatcacacccagaagagtacctgacatccagtagttgctcaacacatatgttttcaatgaatatacaaacaaaagaaagtgttgagtgtgcattacttaataaaatctcattgccactcctggaaaagtggcaaagctaacctaaagaattttgtcttttgtaaagctttcatattaaaatattatattgtttttgccttattatttttaataatttatcatgggggatttaacacacttttaaacatttttatcatcttgttattattgctcttttttggggtgtctttacttgggggcttttattaattttattttattttattttattttactttaagttctgggatacatgtgctgaacgtgcaggtttgttacataggtatacatgtgccatggtggtttgctgcacccatcaacccatcatctaggtttcaagccccgcatgcattaggtatttgtcctaaggctctccctccccttgtcccccacccccaacaggccctggtgtgtgatgttcccctccctgtgtccatgtgttctcattgttcagctcccacttatgagtgagaacatgcggtatttggttttctgtccctgtgttactttgctaaggctgattgtaaaacagtataattgaatatgacatacagttgatgcagcactctctgcatataaaatattttaattttttaaagctttctaagattaaaataaattttaagggtaatgcttttttaacagaaaataccatgtaattttatgagagtttcttttccttcccctcaaagatttttaaaagacaattctcaaaatttgtataaacatggctattagaattgcataaccaagccagagagcaacatccatggtgtcacagaagccatgaggatcattccaaggtctaagttgcaattattttccctgcagccgaattaactaaagtctatacccttgatcatacacataacaaaatgtaataatcttgtcatgctacaatattaaatccatatattcagccaggaagatatttttagttggcagatataacacaaacttatgacttcccctttttaggtgctacttctttaggtcatactgtaagattcactcagttttatttccaaaagctcaaaataactgatggatttgctgaaaatttcagagaaaaaatagttctttggcattaaggaagtggcaaactttcagtacaaggtcaaacaggttagatgtcatcagtgcctctttacttaaagatgaaaacagctgtcaatgtttagatgtcagatttcatgtaaatctcactgtccttgaaccactctcagtctgccttccttcatggcactaagctggtgaactagtgagtaagtcttctcttcgagagggagcattcttctctttaccatgctcctttcccagctttcataatccatttatgaacctatctggcccttttagacatttgagttttgacccttgttatatatgatgcaatgtacctagaagacaatattttatggagtcattgttttttacaccatattaccttatgctcatttatatgaacacctcatttcagctgtcatgaactatgagcatttaatgtaagaaagttgaacatttacataacaagaaaaataaaattataatgataaggaattcatcttgtaaaaatatgtatttctttttacattggggtcagaaacatggcaactactcatggaatagatacattcacatttataattgatcaaatctgtcaagaaaacattacttgtttaccatgttctatgcattgcacttgactctacgaaaaaaaaaaaaaaaaaaagcagtgaagaagagaaacatgccaccgaggtgaggagcaggtaataattaagccaactcttctcacttcaaaacaacaatcacctgttatgataagtgctgaggaaaaacaaggaagatgctctgatagaggataaaacatggggccagatgggtaccccaaactggattggcagatggctattcttagagaaatatcatttacagagagacttgaatgatgcaaaaggtaggcatgttaaaaacggagaaaaaagtattccagacagaaaaagaaaaaaagtctgcaaatgccttgaggagaggaagagcttggtatgttctagttactcaaggaagtctggtgtggatggaagatggagctgaaaggagactgaggcatgagttcacagagccaactggaacctggtgatcctgaaagttccaggtcttcagaagtaacttggatttaggttttaaacattacttatgttttaagaagatcactctggttactgtgtggtaagtggattgccatgtgtcaaggagagaaacgaagattctaatagtagtccttgtaatagatcagtggtgggtagactagtttggtggcaggtaatagacctgtagacttgtcaagaattgcccattgatgagatataaggagagtgagggatccctctgaatattttaaagctacctttattttatcacatggagaataccagggaatgatcattcctaggaatacagaagatagggtggtagtcaagattcagtttgggacataagttagagatctctatgagagatctgggtggagttgttaaagagacagatctggcaattagggtcaaggagatctgggtttccccagaagttctagctcttttattaatgagcaacactgacccttgacttggaaggtgacatttgaggtgacctacttcactttatgagtctcaaatttttcttccatataatgcactgctttgttagaggaacacttacattattattagtactcaagcagtataaatgttggacattactattttatgacaagaactctcaaactgcaagatactgagtcagtcattgaaagagttaaattcagattaccatgctggctttattaggcttaagagtgtttttgcctttaagatgttcagaaaaaagttaactataatatacacaatggaatactactcagccataaaaaagaaggaacccttgtaatctgtgacaacatggatgaacctgtaggacgtcttgttaaataagccaggcaccaaaagacaaatatttcatgatctcactaatatgtggaatcttaaaaagttgatctcatagaagcatagagctgaatggtggttatcagaggctggggtgattgtaggggaatgcacgtgaagagttgggaagatgatggtccaaggatacaagctttccattaaataggatgaataagttcaagagatctgttgtaccacaaggtaactacaattagcagcatattgtattcttaaaaatgctaagtgggtataaagtgttctctccacaaaaatgatagttacgtgatgtaatgaatacgctaattaactagatttagttgttccacaatgtatatatcatttaaaacatcatgttgtgcatgataaatgaatctaattttatatgtcaacttacaaattttttaaagatcataaaaaggaattaactggaaaactccattccaaaattaaattggtcattaagattgaatactgataattaattcagaacaaaaagattgttcaggtgtgaccaaattctaaaatgagaaattaacaagttttgttttttatccttgacttgattctaaaaacagagttctcaaactgtaaactcataagcttaaagtaaacttacgatttgctggtccttggcatttttcttttgcacctttagaattttgcttatgctcctttttctgcatggaatgttctctttcctttttctgcctggaatattctctttcccttttctgtgtgaaatattctctttcctttgcctggggagcagcatcttcagctaccagctccagtgccagccactgcactgctgagacttttgctgcagcccactctcctcagaccactctcgcattttactcagtccctggagctccctgtgtccgtctcagtcatagcatttggcatttggtttctcaaccgttggtttcctttcctgcttctctcacttgatggtgaattaattggggattgtaaattcttcagcactgattattatgctgggaacgtagtaggttcctgagatgtatataaggtgattattatgctgggaacgtagtaggttcttgagatgtatataaggtgattattatgctgggaacgtagtaggttcttgagatgtatataaggtgattattatgctgggaacatagtaggttcttgagatgtatataaggaagacaaataggcagagaggaaaaaaaagaaattcaatttttgtttgtttttcagcaagtctgactgtattttgccaatcacatattttagaataaaatgaatcaaaatacaaaaacatagaattgtaatactaaatactctagtttgcctgaaatttttttctaatatttataaaaagcacaccttgaaatatcttgaaataagaagaaaaaaacatattatcaacacaaatcttttattagaacatttcaggcaaactgatgaacaaacattttaagatattacgataagtggctccatatgaattattttctgggatttgtagtacataagacaactctgttggctttgtgacagttaaagaagcaagtttttttctgtaaactgatatttccaggcaaacaaaattccagcactactgcctcctttgtccagaagacaggttaatacccaaaggcaaatgatttaggcattttcatcaccaagatcaatgtttaatttcttcacctaaatagattcctctttacccttttgacctacctacagagtcttgtcattcagcacccctagaatcacagagttgggagggttcttgatgggggggtaattctagctcttcccaagctgcagtctccagacaggatgaaatatgtgtccttcaaggtacagacattcaccagtttatgaataaattgtattgtcttaagaaatctgtcatttagttgttgggacacacgttcactttgttaatagaaatactgctgaaaacagttttttctgcagcctgtaaaagcctatttatcttataatggattgacagtgtagcacttcatggtactcaagaacccaatcttaaaatgaaaccgcgattcaccaacaaagcattttcagagttctggctttgcttatgggaaaaacatcttcttccaacataccagcaacttgacagtagcaacaaggactccacgagcaacaaggactccatgacagcatatatggcgtctctcatggtgtaggacaggaaccccagtaagacaagagtggagaagcagaaacataagatccaggttgtaggaattaaagaactgtaaggaaagaaccttccatcgtgaaactcactttatcaggtgatcagctttcatccacacgccatgttcccactcttctcaggaactttccagtcttatcttcttctgttactttctcttttaataaccttttaaaacccatctagtatcactttactattagctttttgtgttctagcccaagaaaattttattctctcctactgataagctgggcctccatctcaccacagggcctttgcacatgctagtaccttttcctgcaatttctttttgccctcaacaatgtattcttgctcctttcatctggttaattgctattcattctgattaggtaaaactctatatttctccactgcaccaacattattcttccctaacacttatcacagctatagtttatttatttctgttattctccaattaattcctataatttccaaacaatctacaagatccatgaggataggaatcctattgtattgggttgatcattgattgtatccccagtacttaacatagtgctggcacctgggaatctctcagtaaatgggatttatttagaaacaagtgagtcacaattacaataaatatctaattaaataaacataaaattttacattataaaataaaaagttaataacttaatgacaattacttgtatcttctcttaaagactcctgtccataggactcaatttaaagctttaattatgctactttttcctcaaaaccaatagacagtttttctcatgttttctcatcattcttacagcactgaaaataataggaaatcagaaaaatttccattaaattctactttgaatgcctccttcaccttacctccaatctatacttttttcattaacccagttgtattagtctgttctcacactgttaataaagacataactgagactaggtaatttatacagggaagagatttaattgactcaccgttcagtatgattggggaggcctcaggaaatttacagtcatggtggaaagggtagcaaacatgtccttcttcatatggtggcaggaaggagaagtgctgggcaaagaaggggaaagacccttataaaaccatcagatcttgtgagaactcactcacaatcacgagaacacatgagggtaaccaccttcatgattcaattacctcccaccaggtccctcccatgacaagtggggattacgggaaatacaagttaagatgagatttgggtggggacacagcgaacccatatcaccagtggaatgaaggtggcaatatctggcatgcataactctgcctcctggtgatccttagaatccttcttcacacaatcatgcaggcaactactactaattaattttactggcaccatgaaatgaaattgatttacaattccttaaagaggtaaaataaaaagtctcctttctgtttacagcaatataaacttttggggaattgtgatgagaacttactttctaattattggcatttctccagctccacccatacattaagaacagctttaaattgttccatagttttgttgtaaaaaggtaatcttggaatatccaggtggacccaatgtagtcacaagggtcttaaacgtgagagacagaagatgagtcagaatgagatgatgtgagaaagtccacaggggccactgctggccttgaagatggaggaaggggacacagcccaaggaatgtgtacagcctctagcagctggaaaaggctagaaaatgcattttcttctaaagcctccacaagagatgcaaccctgccaaaacctatattttggccccctgagatcccttttatgtttttgtaagctgttaagtttgtgacacagcagtaataggaagcaaatacagtgagtttaagaaacttgccaagttcacacagtgaatggatggttagaaataaaaccgggcagtgtgttttacttagctatcattttatttaactgtcaatgtaaaaacaaatacgtgcatgcacacacacacacagatgtatatataaacatagcataaatatacatatatatgtatatgcatacataaatgtaatatgtgcatatatccatgtatacacatatatatgcatgtgtcatttccaatgttgtactgcctcactaattttggtaatttgaaaataatacatttctatggtaatacaagagcagagatatactcggtatcaaagtggtactaaatactgtttatacagcctgtttcatgagatgctgaagatgtactgtaaacagtaatacttacacgaaattaaagtctaccagtgttatccttgggctgccaattgattgtggttcatggatttcatttactttgtgtgagtgcatcaatgttcttttaaagcgcagggagagtttacaactataatttttactaatgattgctgataggtttttcatgatttagatatcaggaatcttgaaatcaaaactaatagcaatagacaagaagtgataaacagatacttagaaaggtataaggaaacaagagaagggcgcttcattacaagaatgagcttggggagcaggtgtgaccagagagtgtagaagctgtgctaaaagccaggctttgatgtaacttggaggaagtatttagaacagttagagaatagccacttcctagagccagaaagaagacagatcaacttgtaattccattattttccaggtggatgatactgaaatgtatagttaacctctctgagcttgattcttatctctttaaaaagcacattaatatctaccgcaggaggctgttgtgatgattaagtgagccaatgcatgtaaatcacctaggattggtagatgttcagcaaatattatttcctttcttcctccctgctgtctccattgattctttgctaccatgctttaaggtcatacatcctgaaatttgctgccatcaaaggatataatatagttgtttgcccactttttaaataaagtaggttaaatgaatttattttcttttattataccacctctttgggcctttcttattgaactatgcattatgattctttgaggaacataacattatataatagaaatcacttctcaattttatttttcaacaatttttttcacaggaaattacatgagagaattgacatgagactagttcaacaaaacttatcacaagaagctcaaacttaaagtaaaatcttggaatcaagcatcagaatacatgagtctatagttctatcttcactgttttgtggttgagttgagttcaaaacaaatatgtaatgttttaagaactttgttctacctccgttgtctcttctatgaagagttttgaggatgaaactgcaagcagtatgcaaaagtactatccagagttaaaagctccatgcaagcatgagattattattacgttcttttatcatttgacccactatttgttccacaatgtgaaaggaatatagctgattgctcccaaagaccttggtaggtcaaagtaaagaaaagtgcatattatcaggccagaggccacaaggtgtgagactggatgaaatgaacacaatacaatgatctctgtgagaaaataatttatttcaaaataaatgccctaactctagagagctggtagagtttgggacatgaggtacacaggctcttttaacattttcattgaattttcaagcattgttatgtagaccataataatgcacaaaattcttcagaagaatacctggtctcataacaccctccatcttgttgagaagctacatataggtctcttcttttctctgagattcagtattggaaatgtttagagagatggtgggaggattataaattaacagatttttatagttaaaaacatttccaaaaatgtggtctgtggaatatttaaacctagagaactcttccccccaaaaaaattattccacgatcaatgacatttaggatgcatggctctatcccccctctaggagcttcacaaggcacttgaccaatctaaaaactcctggaagtcctgaagtaatgaaaaagattaccttgttctaatgcaatatgtccacaattatttaatcatgttaaacattatttgcaagaaacttacaaaaatttcaccagataatattccaccaaacctgtgggggaagtgccccatgagataatatcccaggtccccaagtcctctaccattcctggagtgtatatggttccccaggagggtgcaggaaggacttggtgcctctacttctacagccttgagaccttcttttataatagtattggtccgcccccatggagtcagtttgtggctggaagtacagtttgcacgattagtgtgcggaacacagtgtgggctgaacaggctggagggaaaaggctgcttcttggggaccaatttttagaagaaagtgcctcctctgtctcagcccttaccaattcttcttgccagctgtggtgtctgtgtttgcccactccagggggattacacattcattttatgtggcacaagaggctgagaagaaaaattgctggcatatgagacacctgtgacatttggggtaaacacaattacataaagccctggtttatgggcttgtgtcatcactatgggaggatcaccttctccctcctccaatggatgggagacctggctataagcagcagaaggggactttataggctgttagacaggcttgacatgggctctgggggtcttccagtcaggatttgcctacccacgcaaagtgcaaaagagaaataaagcatttaaccagaaaattaagacccaaccaagtcacaagaagttgattgtagcaaaagcaatgtacattggttttttctaataactgttgacacataaatctttaattgctaataatgtattgcttatgcactctgctataccatatatatatatacatatatacatacataatctcatttatgcctcacaataatgctccaaggaaggcatttcttatactggttttacaaatgagaagctgaagctgagagtgaagatacggtttgcccaagttattacatacaggaagatagcagaccagaaattcagatcaggtcgagtcaactacaaaacccatgttctggaaccactaaggtatggactcttcctgttctgcatatcttccttgtgttcctccagatcgattctccacccttctctgcccctctttttgtcctaggaggatgatctgcatggattatttttataagttccattttctctggcttcttgttaaatgtgaccaatagaggtcactggcagggttggagggggttcctttaactgactctattctaccatcattgcttttctcaatgcagctaattctatgtaattttctcgctcatagttctggtaaccactttcttctcttttccctttgaaccaagggttgtgtgttagattgctcacagagatagctgcaattattattttcattgttgtataaatattcttttgtaatgagactttgtttcttctccaatataggagtggagtctatttccccatcccattaattagtggtgttcttatcccttgctttaaccaagagaatgtgacaaaagtgacattttccatacgtaagttccagaaccatggcctcaggaggccttacaatttctgccttttcctttttgaaactttaagatcatcgtataaggaatcccagttacactcgagtatgaatgaccacaagatgggactgccccagctaacagtaaaaacaaaacttcagtgatgtgaatgaggctacctgggacctttcaacccattcaatctgccagatcactgcacttacatgtacaatctcaggccaggctagcaggagggctgcccagatgatcctagcctaaataactaaatcacagaattgtgagcaaataaatgttttaaaacactaagattgggaggtgaggttgttatgcaatagatgactgatacagttgttcaactgtcttatgcttccataagttcattttgttcataaatccccctcaaattatctgatttcatgtctaccacctggaccctggctgatacctccaccatgacagtctgataattaatcgaagacttatttgaaaaaggattaccataggatccatctccccatgctcctgaatccatagacgtgtttctctaggaaatcttaattaatagttatatataatagttacttggtgtctggtgtgttgcttacattatcactgcaaaactggaattaagtattattatcatcctattttacttacaaaaaagcagaaatttggagataaaatacttaattaggtgcagtgctagtaagtaccaggctctgagttcaaacctagatcttcactttactccaacacttatgttctttccacttcgtcaaactgcctcagaaattgaaattttagttctaacagctaaccaaccatagacctcgagcacaaactctgtcaacttaggaatctctggatgtccattccataaaaggtgttttgaagctgtaatttcttctctcagggaataaaggtcagattagtaaaagcatattttgacaccatcaaatgaatgtaacttatttggccttcaaatgtagagatgtcaaatcattggtgtagtttcctaataggtcattgcctaatgtttgtgcagtttcatagtaaatctactctagaaatccatcttgtagacccccaggagtaaaagtagatgttcacaaatagagggggaagtagcctgtgattctttttcactatactttctatatttaacatttacgtttcctgtaagaggctccagagataaagaatttatgttaacataggtctctgagggaatatatcatccgaagtgactctagcagattcctgagtatgacaggagcaatactaacttaaggatttgtgctgaagtaacaggcagcacagagcagatgaaaatatattcttgtgacagagcacggaccacattgttaaaggccagttatagaggctatgatgataatagaaacttttttttcttcctttggagagatagcatagatatggcacagtacatcttaggtttggacgctagttatgatgtcttctcattgtgtggcatgaggcaagtaacttgtaacctacaaatcttgttttctttcactatgaaaagaaagaataacaatgacatcaacttcatatgctattgtgaagattaaatgagacaatgagtgtaaaaacttacttgaatacctagtatataaaataaattaaattgttctttatcattggtgtgcctaacacaacaggggctttacacttattgccccatttggtacttccccattcctctatggtgaatatattgtccatttctgtaactgaggcaagttacctacccaaggccttgctgccagtataggtcaaaattagaacttgctttgtcctctgactaaataaaaatcgatctttttcctccacatattgtttccctgcatcagtctgcctctccctggatggtgcatgcatgtgtgtatgtgtgtttatgtgtgcgtgtttaagtttgtgtgtgtgtctgtgtctgtgtgtgtgtgtgtgtgcccaatccctttcatagaaaaagcacagccatcataccacgcacttggctgggggtggggggtgggaagggggcttgtccaacagaggggatgcatttgtcaaaatccatcctctcctatgtgcagtgaccccccacacattaaaataagagagccactgcaggaagctggttccattcatagcttcagaacagagggaagataattgggctatgtagggagtgagcctatggccttggcctcattagcaacatagtttaatcatcagagccaagccaccacaggtggctgtgccccatgcaagtgttgtgcatttcatttcctgaaaacgtcagtgtctgagaatataaatattacttataatcctgggatgattgtgcaggtactaatggaatggtttcatggtattgattttcaatagctcatttgctataatcagcttaacttcatctgctagaaaacgaacttctaattccagtctgaaacatagtacaagcaaatgattttagcctagtctgccaccaccttgaatcccttatggaagtaggctgggtataaatcttaaataaataaatcaactttagcttttcccagattttcatgatcttgcaagattgattttcttccctttaatctgtttttaataaaagagatattttcctttgagacatggtccataatcttttccatgtgtattatcattctcatagacatcctcttttcaatttcaagagaagcaaggcctcttagaggaaggtagcttttgtgactagccaaatctgcacaaagttggaggaattctaggaagacggatgggcctttggtgtaggttggaaagaacaatgtttaaaaataccctgtctcctccctgagaggtatgataccatgattctctctctttatctaaaggtattagtctaaggaattaaaagccatttttctatgagaagaaaaatgaacaagatatgggaaggtgaactagcagagcaacatatagaaataataataaaaggccttattcagaatgtaaaatacactatactaaaaggtttaccttgattatagcactcaatcattccaagactctgagattgtagctattatcatatccatatcttatagaagtttatagagttacatgaacttcctcaatgtcttgcagctagtgtgaaggagtcaggactcacaccatagcacccatattccagaacccacagctaaccactggattctatgcctatgaggatacataatacttactgtttcaaataactttataatagttttcagttaaaatcttgtctctaggcttttgggcaaagaactttaaaaactctgagcctccattcctccagcttaaaaatggagacagtaggtaactcttaccactgagacaacgtatgtaaaacacatacacacgcatgcacatatatatacccccaaaatactggtgttctgattcccattttacagatgtagaaacagggactcaaagttgtcaatgtgttcaacgttttataaaagcagatgaaagagtcaagactcaaacctaaatctatctgactgcaaaaggtgtggcattacctgggcagcccattgaggaagtgctcggagctcattgagtgggtgaggatcttggcaacctggccagggaggcaatgggagaatgactggatgcctacatgtgactgtgataacctgtgtatggaatcatttgagagaagtatcaattgtcccaaaatgtctaccggagcagtgagggtgaggtaaataattgaaatgtttgttcctgaagatgggtacagtattaagagtttctaatgatttcttataagctcctgtaactttaggattttttgtttgatgatgtacttgaggggaatgtgacatcatctgtgtgacgtgatcaatgcagtagatgaaatgagtatttaaatacctgacttaacctgaagcaggataattgttaaaccagaggtgagaacacagattgagaaggtgaccatctcaaccttggaaatttgaacaagtattcccagaggaagaaacatttgactcaggacttaaaacgtgtaagagttttacaaagaaggtattaaataagagaaagggaaaaaagaaaaatgatgtagtacattctggtcagtcaacaaaacatacttatctaaaagctatgaagatccttataaattaaaggcacagaaagaaatgctttatattggtaaaactctatattttggagggaataacactttaattttcaaagtgctttcatttatattaactcatctgattcatacaaccctgtatatagaaggaaataatgtttggtaagggaattgggaaattatttaaatgagttgatcatcaaacaaataagttccaaagctgaactaggacccaaaacctttacatcttgatctactgctccaactagatgcagtataaacagggtgtttacatgtttaatactaggagcaagggcagtgccatacttttggaaatagtaagaaagaaataatgcgcttgtagatctttaatgctaagaaaaagaatctcctatggcatgagattgaggacttttagaagcaaagaggtgaaaagtgagaagtctttatttcagaagcatcatataacgaatgttcatagtcaagagataaataaattattcattattctctctgagagaaaatcaaaggactgattttgaaatattagacatttgtagcagtagacatttgtatctagtgtccactatgataatctttctaatttattttcaacactacactcagaaatatagattcctgattatcagcaagtagcaaaatttcttcaggtcctggctgtttcttgtgttgtattgttggtttccagatttctaagtcaatctgaaggttttttctaagtaacacgacttgcatcgtaagtacttttttagtaaaaagttgtagtaaagagttactggtcttgcattagatataaccactttatattagttttggttatcccaagcaaactgcttgacttctgcctctctctctctgtctctctctcttttatttttttctttttgagacagtctcactctgttacccaggctggagagcagtggtgttatctcagttcacggtagcctaaacctcacagcctcaagcaatcctccctcctcagtctcccgagtaactgggattacagaagcacaccaccgtgctaggctaattttcaaaaaaatcttttgtaaagacggagtttcactatgttgcccaggctggtctcaaactcctgggctcaagcaattctcctgcctcagcttcccaaagcactgggattacaggcatgagccattgcacccaggctgttttctctattttatagctaaccccaatactaataacagctaaaattaattgagcacttactttgtagcatgtattgttttaaacattaattcaaacattacctaatataatcatcatggtactttgatactttgtgatattttttacctctgtgaataccaagaaagaagcaattgtttaaaagcaggaaaatccctgaaattgaggaggcatatgttccaaccccaggtcagctacttaccagctatatgacctctggaaaaacatatacagcaagtcctcacttaacattgttgacatattcttggaaactgaaactttaagtgaaatgacctataatgaaaccagttttatcataggttaattgatataaaaaaggtaagttcttatggcatatttctgatcacaaacatatcaccaaacatcaaaatgaatacccaaaacacttctaacattaaacattgaaataaatgtgagctacacatatatttaagaaagattaaaggccaggcatgatggcctatgcctgtaatcccagcactttgggaggccaaggcaggaggatcacttgaggccaggagttcgaaatcagcctggacaacctaatagtccacttctctgcaaaaataaaaataaaaaacaaattacccaggcatggtggtgtgcacctatagtcccagctactcaggaatccaaggcagaagaattgcttaagcccaggaggtcaagacagcagtgagctatgatcatgccactgcactctagcctgggcaacagagcaagactctgtctcagttaataattaattaatcagtaaggtcattatttacccacttattcataacagttcatggtctcgggtggtcatagcctatcacagcagctcagggaaccagatgggaaccaaccctgaacaggaccctggacagcatgccatcccattggagggtacactcacacacacccgcactcactcagactgggaccatttggacacagcaatgaactgaacatatgcattttggggttgtagggggagacatgagggtcctgataaaacccacatagacatgaggagagcatgcaaattccataaacacagtggccctggcgggaatcaattttttcatcatcaacgttataaggaaataacattgaaagaaacaaagttatttgaggacctgcttatcataaatagaataaaatcaatttcctgaactggaaaatgcagataatagtctctgataagtagcttaggcaggtaaaaatacctaaaataataaagcagaacatacagctgtgtgtctggtatgtttcggaggcccaatgttttccgttgggtttatttaccagtactttagtccacttgaatacttagtttacataatcctgaaaatacaattgagaattttattctctgcttaattaccagggttgatgttgtggatctaatgaaataatgcatatgaaatgacttgaatattgcaaagtaccatacacatgtaactgttgttatgattttccttgcaacttaggtggaagctatttcctatttcaaaactttatgatcggggaaaagtaatcccaaaggacctagaaataagtcgtatgcagtcaaaacatgagaaaatggttgtaattttactcagacactatcaagatgcaacaacctgcatatgtgagcaatgtttcttagaaaggctcagaacactttaccattttctgttgtgttcaccacctagaaaaaaaaaaacggttacagaagagatttctgcaatttaaggaagaatttctaagattgtcaaggtgataaaaccccagcaaggattattgaattaagttcttgagactccttcccaggagaacttcaagatgagaacaggcatctatctgtcctacatggctcagacatttaactgctggagggcaagttaaaggcttcctgccggactagatgagtcgtcaaggtcccttctagctcattcatttcttattcaccaattatattccaactgacaaccttccagttttttaaagggactcaccatatttcttaaattacaactcattgctaaactttaaaatcattgccattgattacactttatataggatacacagaaaatagatgtaatgatctgtagctagatttgacctacagcttgcgggttaatgtgtagggagagtgggaaaggtgactctatctgatgattcactacatgtagaaattccatgatataaaacctgaagtgacagaaaccattgccatcccatgataataattttcttggggtttactttgtggttcaatgtccaggtcagacatgatgacattttagcagggatttttttgtgtttggaatattttctttgttgttttttttttcttactttcataactaatttcccttgaaagggtatgacttggatctgacttgttctgaattttacgctacaataaaacatgttagggagaaacttctgtgtctctgacagcctgtcctctaaaacacatctcaacatgtgaactgatgaaccaaaatgccacaaccttgagaagaaattaactcagagttattcatcttcgaaatccatgttttaggtggtttccatggtgactccctggctagcagcatctttgtctaccagatgtcttattgttcaacagctcatctgtcttcagagtttaaggtttgaaaactgaagtccaagcagaacactttctctaaatatcacagagaagggggaaaaagacaataaaatcattagaatgtttaacggacataagatgggaatggcgagcagagacattgttctgccatggtccaaatcagtgcatgacaaatgatttaggttttcattgggttctgagggcataaatatgttataataatgaaagaaggcttaattatacttaaaacagaactcctactcacttggcaaattttatctccctattggctccacgatatattagttcacatggtaagccacttacttctatcaagtcctgattgttgcaagacaatctgcaagttgatatatgaaagtaacttcaattcagaggctttttttttttcttgaagaaatgagagtaagtggctgctaaaaagattgtacttatatattggcttccacgtctaaagttctgaaaacatcctggaacaaagtcactcactctgttatgttttaattcggtaccaattatgactggccatgcttcaacattgtattccaaaatgagaaaacaagcaacagtaatgataaccaaaaaggttggaagcagtgtagggccaggtgtgaagctgaagaaaaaggctgaaaaccaaagctctgatcctagggttcctgttcagtgaagtgcctggtttgtgtgaaggcaagctggaaagagccatgctaggctgggctcacttgtccacattcctcatggaacagccaaggaaactaagatctagtgagataagtaaattattcaaggtgacaaaaattggttgtgtgactgaaatcagacttaggatcagtgatttcccagttcacgtaggtggaaataggtgatagaggttaagtgattcgtacaatattacccagatctctagaatgtagttttcaaaaccatgcccataaactgtagttctgttttgctttttaatgatcaccagcattgactagtaaacctctctcccaacctactccaccccaaattgtcttttccttgttcttggagccgactttgagactcaacccctttcatgctgagctaaatatcaaatatgtgaaagatgataacatccactaactatgtttaaaagacaagtttcaatttcattgactttctagccaatgctacctgttaagtcaattgcacaagagggatttgccaatcgtctaccatgtatgtgtagggagggcatggtgcagagcaaaaccatgtacaaaacagtcatcgccccctcagaaagttgacactgtagctgatagaaaaatgaactgtcccataacaagatggaatggtatgctgtccccatattacaacctcatgtgaaaagataacacagtttgctaagagtttttcatggacgatcaaactaagaagagataaatttcagctagagtaagaaagataagacggtgggaaacaatgaacgacattagatcctggaagaggaactgcatttggaggaagaaaggagagtgaggaatatttttatctataaacttgagattcttacctcatagggttatgatgagaattaattcggaaaattatataaaccatttagcaccttgcttatcatgttaaaaaatcatgtaaaaataaatgtcatttttattatttaatgatccatacagagttggggtggaaagaatattatagaaagaatctaaagttcttggttcttaatccagtagcaaacagagtaaaataggaatatcatctaatattgcaggatttattttatcattgatgaaatgaaagatttagctaaaatgatctctgggatccattttcactcataaattctatgattctgggacaccaaataaatgttttattcgtctatatttgcccacaatatgcattttttagacccacagggaattttttctgaatcgtggactcagaaccagttaagtgcatgactgacacaacacatgaactttgaacaattacattcaaacatcaggacagtctttgttaacatcgccaactctcttccttattaccagtaagtttttttttttattcgctgtgtaagggcgattaattcacatttcttataaagttgtacaatacaaattgcataagaaaataaatgactcttttctattacttggtggaaaaagttgatttatagtccctgagagaaagaactaaggaagagagttaaaattccacttactatatgagatttttaaagatctagcactcatgcatgttgtgaaaatactaagtatctcaaataatgtgtgagattctccttagaggtaaggttttatattgtcaagacattttttcttttattttttctattgagttactgtctttatgctttacttgtacctcatactataaattaaaagattagtgttcggtgtcattgcattaatgaagattattatttacaacaatagctagaaagtgattggaggtttaagtccagtaacttgagcaattaaaacccttgtagattcctatgaggtttaaaaaatacatgttgttaagggaaacctatgtactcaagaaagatagttattgctagtgtaccttcttcaggaaaccaaaaatgtctctcatcaaaaacggcttctggaaaagactggagttttattaacatcttagtatagatttaaagaaatgaatctcttctcctaacaactagatttcaatcctcttttcagattctctaatcataaaagctaaacatcataaaataattgaagactaagtgataattataatgaacacccaccattttacccacctactctttctctttttctcatgcatttctcttctctctgtaaaagtaaaagcactttattttatttattttattttatttttttaaattttaattttattttattttaattttattttatttattttattttggagacaagagtctcgctgtcgcccaggctggagggcggtggcgccatctcggctcactgcaagctccgccccccgggttcccgccattctcctgcctcagcctcccgagtagctgggactacaggcgccgccaccacgcccggctgattttttgtatttttagtagagacggggtttcaccgtgttagccaggatggtctcgatctcctgacctcgtgatccacccgcctcggcctcccaaagtgctgggattacaggcgtgagccaccgcgcccggcctggcacttacttttctctggggaactgcccctctatgtttcagtgtatcccttttggaaatgtcaactgcagtgacttgcctcttcatcctaacttctggccaatcagtgtgggctattgacctagacatgaatgatgacacttgttttccctgaaagttgggtcttgagcaaagtgacacacaattaaaaatctggatggagagttattttgggttttgagactgccaaagacttcctgcaatgaagatctgcactctgaacttctgagctgctttggttcccatctttcctgtggctgggtccctccctctctctgtttttcctgtgagcacagatgactacattggtgaattcaatcaaacatttaaagaagacataataccagttgtaactgtattcggacaacagagtttatgtgaacatttcccacctcatttgataaggtcattatatcagatattaaaggggagagaaatacatatactttctgctatatataaaaataaatctttttttatatatagtgttgataaacagatataaatatatgtactataatatagatataaaagaaaaaactacataccaatatcactcatgaacatagatacaaatttttttaattataagcacgtagtatctacagacatatatatcataaatatatctatggaatatatggaataatgcactataaccaaacaaaaaatgcaagattgaatattttaaattcagtcaatgtaatcaccccattaacaaaaaaaagagagaaaaaccatattatttgaatagatgctaaaaaaacatttgataaaattcaacacatatttatatttgtgaggctaaggaatgtccttggatgctaatccaccatgttgatttctgattaacctctgttctgggaatgcttttcagctttctactttatgtactattaccgtaaatcctatgcttctgtcaaagcaaccttgaccataagaccacaagtccttccctcaggcagattcacataactttcttgccttttcttggggagttgacttcagttgccctgcacgtttcttgtctatgatatataagccctggatcttggtggtaagcacatggatccatgaactggtctctcggctgccctagactattgcttctgcttgtaaatctgtattcaaggtttctgagaaactgggaatgtcgggctctttctttgtccccaaagcttccttggccttttgggggaaggtttgcatatgcttgctcaccatagaacaatactaagtaaaaatgttcagcaaacaaaaaaatagaacatctttaagatatagtgcatctaccaatatcttaaagccaacatcatacttgattccgagaattcaaatgcttttctaaaaggatcgggaacaacacaaaggcgttttctcaaacaatttctattcaacgctgtactggagatcttgctgaatacaatataaaagaaaataaataaaaggcataaataatggatagatcacagcactgtgtaccttaataaatgtaaaggaattcacaaagacaataacagacctaataagtgaatttgacatgggtacagaacacaaggtcaatgtaatacatacatacacacatgaacaatcaacaaatggttgggaaataaaattgtttaaacaccatttacagtgaaatctaaaaagaaacaaaaattataggaataaatctaatgaaatgtgcagaaggcatttttagtgaaagacatttatactgaaagctacaaaacagtactgatagaagaacaaaacaaatacagaattgacctggccatgagttagaaggtgcaatattaagataccaattctcctcaaattgatttacagaatcaataagacccaataaaaattccaaaagactttttaaaaatagaaatgaacaagttcattgtaacaagcatatgaaaagaacaagaagacctagaatatctaaggcaatcttgaagaagtactgcaaactcaaaggacttactataactgatgttacaactcattttggatctataaaaattagacattatgctgttcatgaaagggtacacaaataaatgaaggcacataatcaacagtactgaaacagacacctatataaggtaacttgaattttgatgtaagaatcaatgcatttctatgtctaaatgaaaagttctttcaacagttgatgccacagcaacttcttttgaggggaaagaacttgaattttactttacatcagacataaaaaattaattttaggttaatcatagtcccaaacatgaaagctaagtctataaagcttttagaaacaaacatggaagaatgcctttataattatagtataggcatatattatttaaatatttctttaaacaatagccagccaagagaatttgacaaactacacttcaaaaaaatgaaatatttgctcatcaaaagttatagttagtaatgcgaaagggtaaatctcaaactaggagaaaatgtttgcaatatgtatcttacaaaggactattatccaggatacgaatgaattacaagaagacaataactcaagttaaaaagttaaaaacacttgtgaatacatacttcacaggagatgatgaaaacccaataaacacttcatattattcgtttcaatgctaatacattttaaaaccaaaatgtgacatcaatttacatccactagaatagttaatagtaaaaagtctaacaattgcaagtgttgaggaagatatgagaaactgcatgtcttgggtaagaaaagtgaaatgtaaaatgatacaatcatgttacaaaactgtttgacagtttctaacatagttaaatacccaacaccttatgattcaacaattctacttctattaatggttaggtacccaagaaaattggaagcatacattcataaaagatttacattgtaggccgggcatggtggctcacgcttgtaatcccagtactttgggaggccaaggtgggtggatcacttgaggctaggggttcaagaccagcctgggcaacatggtagagacaacagctgtctctactaaaaaatgcaaaaatgagccaggtgtggtggtacgcgtctgtagtcccagatgcttgggaagctgaggcaggagaatcacctgaatccaggaggcagagattgcattgagctgagatcgcaccagtggactccagcctgagcaacagactgagacaccatctcaaaaataaattatataacattgtcgatgagagtcttattcataatagctcaacacttgaaatatcccaaatttccatcaatataatagataaattgtatattcattaaatggaatactcaggaataaaaagaatacatttctcaaccacacaacatgaatcactttttaaaatactattttaaacaaaagtagccagacacaaaccggtacatacactaagattccatatatatatataacttcaaaaacaggcaaaattaatctacagtaaaagaattaaagctacaggttacctctgtaggtggttaagattggccaataaggaacatgagaaaacattgtgggacgatgagaatttctatatcttaattttaacgatggtaacaggtgcatatataaatacacacacacatatataactgaagtgtatacttagtatctgtatgttttactatagatcaactaaccacattaaacaaaaaaagacagagagacacaaaagtatctttatttctagatttcattttcatcaatacagtaaaccatagaaagacactttcttgataaatatctttattaaagaagtgtagcaaaacaaagggtaggaagttgaagttaggaggatttaataatcaactggtatttctaggtatggcttttaaagggctgacttttctggatatgacaagctggcaaatgttctcagagtaggctttcaaaaaaataatgttttccattttcgtagaaatcaagatttagtcctttgagtaactaagataatatagtagacttgaaatgattaatttatagaagtcactaccagttgtcattataattatgattttttattattaaaataattattctttgaaaagaataatttgcatatgccacacagaaaaataatgtattttagtaaatggaggacttaaatatttagtcaatgcaacattaggtctactcaccagataatcaagatatagcagtatgattctgacaaaaatatctttctctcaatatctggaatattaataaatagcagtaagatccagtttgatttttttcactctctcaatatcctcgtaactcaagcaaagcaaattgtagataatttgtttttgaaatccagatttattcactgagtgtaaagatggcaatttctgttttttgttaaaatgaaatatattttcccttcaacttgtcatataatttacccactgtcctcactgcttagaatgaaaagagctagtattttacaatttgagaaattgttgtactcagaatatacacacacatacacacatgcaaatatacatatccagattgctttgtgctagcaccaaaatcatcatgaaaataccattttgaaacttgaaaccccaaaatccttttggacttatgttttagttactagtctgtttacacagtcatatgatgacttttctcttttttacaagtctgaaaaagtttctttgcaatctaagggtccaatattaccttatgtatcattatagtatgtatgcctaaatatttttgcattaaataagtagagctctcttaaagttaatatatctttatgaatattataagcagagtagaaatccatacaagtatagtataattggtttcctgtatatgcgttgggcctttttacccagtgactccaggagaaagatctgagaaaatacagaatgtagcaggacttctacgaaagttgagttaccaaagtcaaagtcagatcaaaaggaaataaaggacagaacacttcagggagtagaaaatattccctgttgggtaaaatgtaaagattccatatggtgctggaaatgtgccatgtcctcggcaccccttgtaaatgttttgttagttcactggtgagtctgcctgtttctctctgacttgatttcacagctttggtcactgctgtccacagtcaggcaaacacaaaaggaatcatttagctgttcttcggcactggaaattttcttcatactgaaaaaggcagcagggaataccatttgtctttcgctttattctgagctatggtaactaaggctctgggtcccctggttcccattgatctgtgcaatacagaatagcaaaattggctactgacagccagctggggcaatcagcaccaagacattcagagggctatatttttcttccattttaactaggtccagtagctacctgcgttgcaacagcaccagggtataaggaaggactccttttgaacaccattgcaatcacgatattgagcatagcctctatcccagagaaggcattcaatgcaactttgtgaatgattgaatacaatagcccactatattactttatagccattactctttataattattactctaagcccagagttgggagctgcagagttgagaatattgttaattcctgacttaaaatgaaatgtgtttggtattgtccccattgccctcaaataaggccaagcccccttagattgacacacaagattgcaaccctgatttttttctaacctcacaatcaacatccaaagcccacatgtgatgagtaattcaggggtcatagtctctcttaggtctgagtcttgtgcatcttttcactcacctgcgacagccccacccccttccatgtggaatgcctactcagctttcagatctcagactcaacacctctggctctgggaagacatgaggctttgggaagtccgggctggctttcccttctaagtgctcccacaaagccctgagagccccttattcttcacgcagtgcatggcgattgcatgtctcaaccaccaggccacgtgtttagagacgccagccacacccttccttgtcttcgttactgctgctgacagcatgctctcagtacacaacctttgcgagaaagaataaatgagtgagtggagaagcactagccattttcagggtgaattggtggtaatcagatgctggaatttgctggtggagtcactcagatgaggagaatggccaaaaatttccttgaggtactcaatagaagtttaaaaatgaagaaataaccccaacatcgagtcacaataactaagttgtattttaagtggttgtatttaacatattagcacacacagaatatataagatatttggaaaaaaatatgaaaagtctcactatagatgcatgaagacgttgtgacccaggtccccctggtcctcagctccttaatgctttgttccatgggagtggtttccaggggattcaggaaaacacaccctgtccagacagaaatgagaatacagcctctgggagaaataaggccccagcaaccactcaacatttttctttccatatcccaggcgcaaataggcactgagggaagagtgagcctttcttcctgcccttctcctcttgcaacattttctggagagggcaggaagacctaggtagccagcctgcgtccaggaagggagcctggggcaccttggtgtgatagatgctgaggggacagggccaccagagggagcctgagagtccagagaagactaagagaatcatgtgaccctttgagggacttgaaggtaggctgtggggagtggagggtctacaaagaaggataaaggggcccagctttcctaggtgagccttgaggaccctggagagaagctgatgaggtctgagattactgaaaatactacaggagcattgggatcactgggggagggttctggggagtctggaggatctgggggaccttgggggaaagcgtatggggtttgggagcatggaatgaactaggggagctaggggtggtcattggtggagcttggacgtgcctggaggagcctggagggatgatctgcccctcaatcaatagaaccagttaagaagagaccatctcccaaccctgaataggctcagtgtccgaaggtaggttgtgtagaaatgcatccccacaatcacaagaatcaatgtgaaagtaatatcaggagttttatttcagctattggtgggtcaatcttttttctctgtggaattttttttcttccaaagtttcctgttttcttcataatttaatttccttcttagctttttttcctcctatatatatgatattatgaagtatatatttggtcttcatcctgttttgtgacatacagctgctaaaacctttgaaatctctggaatgaagagtgtcttctgcttgctaatgagatgacttgtgtctggaggccccagtatagcttcaggaagggggctggtctccagaaataaaaaggcatgattagagtattggaccagtcggccccaccctcaaacctcccgggaggagagaggggctgaaggttaagttcatcccaaatgaataatgatttaatcaatcgtgtctacataatgaagcctccattaaaaaaaaaaaaagagggacatatttcggaggaacttcctgatagctgaacctgtggaggttcctggaggacagtgtgcccagagaaggcatgaaagccctgcaccccttccccataccttgcccatgcatttcttccattggggacgttcatttgtatcccttaaaatatcatttataataaacaggtaaacataaataaagtgtttccttcagttttgtgatctgctctagcaaactcatagaactcatagagaaagggtagtagaaactttgatctgtaaccagtccataacccatccattagaagacctgcacagcttgcaatgcctgtctcaagtaggaggcactcttgtgggactgagctcttgaccaacctgtggaatctaaccctacctccaggtagacattgtagaattgaattgagttagaggacactcagctggtgttcattgcaaaatagattgcttgcttggaattttccccacccgtgtaatgtcagaagcattgtgttgtgtttgagagtatatcaggagaaacaggatttgtttttttctatatcctcagagtataaatattgtttattcattggttattttaaacttattcatgtttttttattcttggcctctcttttttcccctaaaagaatatttttcattttttaatttcttctcacctctcattccttcttcatagattcttatttccttgtgtttttctttatatttttctttctgcacaattattttctttatgttcttttcagttttttagcattaacttttcagtttttaataatttcttattttcttctgtttatttttttatttcttcacaatttccttcttctttatgattatttgctaagtttcctttagcttctacctcatcataacttctatctggtcttcttttcatatattattttcttctttataataattcccttcttgggggcttctgtttattatttctttatttatatttcatattttgtttctttctttataatttctctctctcctctatcttcttcatggtttggagtgtgattcttctctctccccttgatggtgatggacacttgctttgggaccaggcagtcctacatccattcccagttacggccctggttagctggatgtccatgaactaaattttgctttctgaaccttatttttgtgacttaaaggtacttatgtagtaactgcaatattgtttttatttatagaacagtttgccaggaaagaaaatatttcaaagacaaattttccactaaaaaataatacagataaaaaacacaaaatatgggcagacttagacttggagaggaggtgcctacacagactaaaaagctgatgcctcttcaatgtgattttctttaaattttatttgtttcactttgtggctgagggtagagtcttgtttctcttgctctttgtttcttttagaaaacatctatctttaagcaagacattagttcccaaaacctgacttttctcagcaaataatacattgatattattcagcttcaaaattttgactgtgacttcaagattgacacatttttaatgttgcccccaacaatatcgccaactaattaagcaaaagtccactctaaacgtaagcatcgaataggtcaaccattacaaggagagcgtttgcttctcttaaaagtttctttccacctctaggtgcattctgtttcaccagctatataaggatcaacagtgtggaaacctgcatcaactggcattgtatttgtaatttattctgatgattgtttagtgtcctttatatttacacaatttgtggaacccagtgtaaaatgaaaatgtgaggctccttgttcagaattattaataatttcaagaaggcaattctagggcattaggcaagtgcaggactctgctgagtctaggtcctgtacagtggcaaaggtcacacgtttgtatcaccggccctgttgatgttgaagttcttagcacgaagctggctgacctggttccaggtacaggaagtgacacccatgaggaactttcagatcccctttatactctcaaaattttagtttttcttttaactttagaaaacttgcctggatttcagttattcatccatagcttgaatatgtcatttttcttactgcccttctctcctctcaacaaccactagtcattccctgtaaaaagtttgggaacattcaacagacttttacagcagaaagtatataatgtggtggcagagaagccctcttctcaaagtcagtatatttcaaccagtggcatacttaggattttgttgtaagtagcttaaaaataacttgcttcatgtctcagccattacttcccacagttgagccctctggccaaatctaaatcatgcaaagggccaattgttaaagtgaatgcctgctaagtaggatggcttggaatccaggttgaggatgaaagcagcaacagcaggaaggaagaacagtggagtaagccaaaagaaaaaattactgctggcacacttctgttcaccatacaattcatccccccgcacatggcaatggagttggtgaacaaacaggtgcataaattaaaatcatgcaattagcggccatgctgcccaccgctgctgccccagagctgcagtaatgctgacactagttaaacaaccaaagcaactgtcattagctaagtgtgttcacttctagaatatcctttttattaacgtgtttaaatagctggatggcagagatttgctgtgagttctataacagaagccagttaacaaccttaaagaccaaattaattggaaagacatattttaaaaccaacacagaacataagctagggtgcataaccagaagctacaattgctcaagttttttagaagaggccatttacattgtaacatcccgccaaaatagtatgattttttaaaatcacagaaattgcacagaaactagatgtttcaaggtatttatgttaacatttcaggataaggaatgagagtcttctctggtgctcatcattttcaggatgaacaattagcattgaatatgcaatgtggtatttcacttcaatctccagaattcctctcaatgcttcattaggctaaagaaattcttttgatactgcgcaataagagtttatattttattccctatttttaagcaaagacaaagagatgtatttaatatgtaagatttgggagaagaaaagtgaaaaatcatcagtgatgtgaactaactttaagatcacacaaacttgaaactactagagtattgaaataacacttgagcagacttaactcttcatccagaatccctgggtattgataacttttatagtgacatttgaaggctttttgtaagacacaatgaattacagggaaaatggagattttatgaaattatgttctacatgaatagtcatagtagttgaaatgtgaagatgaaggaatgaggcttaattagagaagtaccaaagaagatcaagatgattatctcacaacatccctcaggttgttgtctgaaagtaatggtctccatgaactataaagacagggtgtgtcgtgttgagagacaagacccagacccaggttttttccccagctcactaaatgtgtaaaattagataaattctttaacttttttcagcctctgttttgtaacctctcaaatggggataataatacatgtttacctcatagtcttattttaagtgattaaataaaataattcaaatagtgcttagcagtgcctaacactacctttatgtatgtaacttaataggtgatacaaatttatctccctttaccagtagttttccttgactacaaattgaaatcttcggggaagttgtaaaaagcactgatgcttgaagtcacacttggagcttctaattgaacattcttgggtgtggcctgagcatcaggaattttgaaagttccccaggtagttctactctgcggccaaggttgggaaccacgttgctttagacagtaaatacatcattagtaaccacattaatttccattactcaagaaattcactgaacaccctggcatattctaaacatgacaacttgaccatttctccctgaggctcattttctctttgttgcccttctggggttaaaaacaacaacaacaaccaaagtcaatgagacaataattttagcttagaacttaaggatccttttcatgctctacttaataataaatagcagaggacttctttgaacaacatctttaatgtagttgctaaaacaataaaatacacaacagagtacccatcctttaaggaggccaaatatatgatgccctctcttttttttttttttttatcatacatgagtatttctgaaacaagttgagctaaactttgtatcctttgatatcatgggaaataaggaagcagtgcacattctctaaagaaaatgacaatgatttctcattcattctctcattcttctgtttctgttttcatttgctttaaaaacttctttttcttttaagatctgactttccttccaggtgaggaaaaaagaatttccaagtgaggccaattagagttgcccagatgaagcaaagtccccagggatcaatcagaatgcctacacagatgagaaagtaggaatatgtcctttctttctccttgttagagtttagtttctgccctgaggaattctagttatttattttctatcagaaaaaagaatgagctctccacagcacttaactctttcctacttgatagaaatatccaccttcacattgtaaccttgtgctgtacctcattgacttgtccttagttaattatacagaacatctcattcattcagattatgctaactgggaaataaaatatgtttacaagaattaggccaaaacatacaattgcactggaaatggtgtaaaagagatttatcagacgccagctttaactaggagattagatttatgaatacttcccagattgtgtactagggaacattactgttcatcaggatattaacaaggagtttcgtggtcagattaaattgagaaatgataattaaccattttcattataatgatgataaccattttcatcatgctcttctgagccttgcagctctgaatgtagtccgagattggctgcattggcattacatagttacttgttataaatgcacaatctgtattaattctgtagtcccacccccatactacagaattaaaatgttcatttgaacaaaatcctcaagcgattcctatgcacattatagtttaatagacactaccttggatgatctcaattcatattagtatggcagcaaaaaaaagtttttttaagttgaattcataaatttttaaagtctttttcactttgtttatcctatgatataatgaaattatttgaccacagaaatatagctattctgtttttgaaacagttactaatatttcatggcccaaaactttttcacataagataggaaaaagctaagtcaaattatatttcaaaggtcctggtaattctcatattctgatatcctaaaaagatggtaaagaatatacttaccttctcagaaaagaaatattatttaaaaacgctgagcatcctctattggtgatattgtcaattaccaggtagactatagtactatactggtaaagaggctttttcatgtgtagtctgtttccatctaaaatgatgacctctgaagatatggtgtgtgtgtgtgtgtgtgtgtgtgtgtgtgtgtgtgtgtgtgtgtgttggcagtcagtgttcagcttctcttggctgcatccactacagaggatgtcctgaaatggtcagccatgtctccctccagcctcacattactactgtctccctgcccttctgtattgactggaatttggccagagttctaccagagtagtgcctggatcttcatctaacttttaaggaatcaccagacttaaatttatccttgaattaaaattacttaaataactgaaatatcccctccatatcttccaaagtctacccaaatttaggacatggtgggtgttattcctttcctatacccaggcacacaggtcttttcatatcctgctggtattaattattccaatgctcttcttgctttcagaaatccctagatgaaagtagacaccaactctgttcccatgtgttgcacccaaattcagggtccaaacacaagctgcactgagaactcttttctcaaccatttgctccaacaaagtgagaatgggtctattgtttcttgtcctagtgtatatcccccatgaagaaacaagatgtcattgtccctttttgaaagacagagaataaagtgttccttcttgaaagaatgatttcttagatccatatgttatcttataaaaccaatgcaaagtgtgcttttcaaccaaccattttctgagacatcaataaaaataattttatgctttgtatgaataaatccaacaggttttcagtcttattttagtctcttgccttaaaaaggaataaaaaatgtatgtatttcagaaagaaaatgtagaatttaggctgttttcttccattttcttccttgaaaataatctactttggatttcttttgaagacaagtggacatttggcatttacagcttcatagaattgtaaagttatgtctctctagcaacaaagcacagtgccatatttctgaataaatacgttcttccttgagttaaaattgcttacaaagaatctgtaataaatcaatcttagtctttagatttactgtttaaggtcaaactatgtcaattgtgtttttaaattcagatttcattttgaagcaacattttataattatgtctaatttctatttgtgcttatctgttttgaaaaaatttagattaggtcaatcacaagtcaaaaaaatgactaccttctggctccctctcaaaaatgtccactgttcaaataaaaaaaaataacattttgctcagaaattctaattttttaaggggtgaaagtaagatgtgtttatttatggtatattcattccagagtattcttaagaatgcccttactggaaagatgttaggtctgagaaataaagaggagcttgaaaactcacaagaaagcattttttaagccagcagtgaaagaacttttgatgtttcaaggtcatttcactgtgggaggaaattgatagcgtctaattagagtagaaatgctataaagtctgttcagtagagatgtacttggctagcaggatgaagtcagaggaagtatataaaattttctcttattgacttacattttccatggtccccaaaacttaaatgtatgttaatatcacctacagtgtttttatccttgttgagattaaaatatgaaacctgggagttttctcctgcttagttccttattatgggtattcaaacaaatgctgagttgtagatttaattccttatgaattgcctccacttaacaaaatcccaaaacatttactcagaggttgctatgcaaaagccaccgcagatgcaaaagatcctagagatgcctacaatttggaccttggatttaggtgattataattatagttgcaaataattatgtgtcaatattccgtattttacctggaaaaaaaaattctgttcaaaagttttaaatgtatttacactcactttccaaggtagggggtgatagtattcatgttagtcatatatttatatttcacactatttctctcttctgctttcatcgattgatgagaatggggaaaaattattataaacttaatgcctctgcagtttttctgtgtcactaaataatgagagtctgagaaaatatgtattgtttagcaggacatcttcatgtgttttccaacttaaaaaatacaacatgcatgttttcaattgtaagtgggagctaaatgatgagaacacacagacacatagaggggaattggggcctatcagatggtgtagggtgggaggaaggagaggatcaggaaaaataactaatgagtactgactaggtttaattcttaggtgatgaaatattctgtacaacaagcccccatgacacaagtttacctatgtaacaaacctgcacatgtacctctgaaataagttaaataacaaataaataaataataaaataattgtgattaaaaagagacaatatgctgtaaaatatttatttaataaaatagctttttaatctgtacagaattgaataaaaaataaataaaaatataacatacttaataacctatttccaaatctattcttattaaactattaataagctagggatttttctgaaaaacaatacttttttcttagaagaatataatgttggattccttgctttaactttgtgatgcttcatggatcacctatctcaaatctctcattctacttaatgacccaggtttcttgaattgagtgactagagaaaggaatttatagaagatctttaagatgcttcatttttacccctaaaagaaaaacagtgaaaccaagaggacggcgctagctgtagataatttagggtaattcaacccagagatggagcaagtaattatttctgttcttgtctcatcctggttgccttctatttatcctaacaaaaaagccacaacaagttccctataaagagttcctgttgtccattttataaagaggaggaggatcaactttatttatgaacattacaatttatcagagggactctggttctatgtaggcaaattccaaataacattaaattcaaattctttttattcaagttctatcagatttgctgcccatctgttaatcccacttgacttcacagtgctgtttatctcctaataatgtttttataggattgccattgcatactattttttttgtgtgtgataggtacacatagaagtcacattcattgtccttcctagtaatatctgcatagattctgattccatgatcctttaaaatgagcaaagtgagaggtaccattccagaaagaagaaacaagtcaccttgtaaaatgatctgcatttttgtcatgtcaggagcctgcacgtgttgggttacttcatgaagcaattgttgcctacagtagcatttcagttcaaaagcctgttccgttaaatgccatttcccagttcaaatggacttgaactgattcagcatacaaatggtaacatactctttaaaaatatagtgcagtggttaaacgtgaagattctggagacaggtcatctgggttcagaacctgtacttgctgtgtgatcttaggcaagctacttgatcactgtttcctatatttaaaatagggggacaataacaccaagctcataaatcactgtgagaattatgcaagtttattatacatgcttctcatgtgcctgatacacactgagcagtcaataaacgcttgctgcttctatttgaaatcttaaagagaccatataacaaaacctcacctttgggcaaatgagcaaactgaggctcaaatgttaaataattgacctatgtgttctgtccattagagtccacctttactttctccttatttaaagaaagttgaatgcaaaggcattacttggaaaacctgagttcaagttccagttccaccctacatttgttccataaccttgagcaagttccttaatatttctatatggctcagaatggttaagtaatttttccaaggtcacacagctagtgagtagtgggacttggattcaacttgagcaagtctaattctaaaatcagatttttgtccctactataatgtcaaaggttgctttaggtaatatgtacatatcacttttggtcaacgaagaaactgaagttaaatgtctaatgcacagttacagcaaatttagacagagcttggactacaacggaagtcactaagctatcaattaaatattcttcccactagatcagtgattcttaatcctagctgcatattagtcttacctgggtaacccacttcaaaaagacacctttacctggggccctatctcagacaaattattttttcaaagtctcactgaattaattgtaaggtgctaatgtgaagaactgctgaccttgactgaaagagtgcaaagaggattattttgccaaaacagactcactaccaggttgcttccaaattaactaaactcagaactgtcctaacacaaacacaggtgggagtggctctaagccctgttatttacccttcactttctaacattttatcaaagtcagtctccagtatagatgagtagctatgggaaaatactaggaataatcctcccaggccctcttatttttttcctggtttcttatttcttaactggattgtctcctcctctatgctattatattccactgctggattagtcttactgacagctcttaccttgctattctgctttccaagagtttcagtgattcctcagcacccgcagaggaggtgtaaatacactttatctggagctaccaagacctctagcatctttccaaagtgacgtttccaaacttttccatgactaattcaccttcattttacatgccttaaagagcattgtaactccatagggctttctgaaactgcactgtgctgtcaccctttgtgcttttgctatgttattcctttgtctctaatgttttgccctgtaaccctacttgtgagtatcctacttattgcatcattaagcccaagcaattttctgctttcccatcttgactatgactgtttatccttgaatgcacaaatcctatccagaccattgaaatgccattccccgctttgagctcaatggttcaagactagcctgtccaaaatgacaaaaccccgtctctaccaaaaaaaaaaaaaaaaaaaagcaaaaatagtcaggcattggtggctcactcctgtagtcccagctactcagaagctgaggctggagactcacttgagcccaggaggcctgtgttgcagtgagccaagatcataccactgcactccagcctgggtgacaaagtgagaccctgaaaaaaaaaaaagagagagaaagaagaaagaaagaaagaaaaagaaaaagaaagaaaggtaattttcttgactatttcatccatccctttctcttctcaactcctcaccaaaactttttttaatttattgaacttccatagaaatttttttaatttttaatttacttcattactttgtcacttatatttaaaggcagagattattttggatttatccttatattccacacatcccaaagcctagtaaataatactatagacacttctagtttgccttctcctatgaaagaacaacaacaaaatactagatataatcctctcaggccctcattatttctttcttggtttcttatttcttatctggattgtctccccttctgtcttattatatcccatttctagatgagtcttactaacagctctcacgtaattctgctcttctagagcttcagtgattcctctatgcctacagattaaaggtcagtgccctttatccagaactccctagacttgtataatctagtcttaagtgaccgtcccaaacttatctctatcttgtttacctctaccttctaacattttatcaaatatttaatcaaaattttatctcttctagtctcaagccacacccaaccttcagatggaacatgtggatctggcctaagcccacctgtgcacaccattctctggtccatggtgactgcttccaggcacatgacctaagctggtcatagaataaattttaggagtctgctttagggtttgaaccattaaatgtgtagatagcaaggttctggtaattattctgcaactaagagaaaaaaaaaaaaaactgtttcaaataagactaagagatagagaaagaaaggttgaatcccagagacacatctaggacctctctgtccaggatagcctaaaactagacctctctctgaaccatccagttatataaatcccacacatttacttttatgtttacattaggacttctgtaccttgaaatctatgaaatcacaaacacaagacattcactcaataactgttaggtaaccaatcagcctttcaaccgcattaaaatatgccaggaggaggctatataggataccgcaacaactctctggtttaatttgactaagtttttatttttcaatttttgttttttatctcagcgtaagagatgtaatatactaaagcttatctgatatgaggctacaaaataaacacaaggatagaaaaaaccctcatgtccctctctctattaacctcatgcagcaagggtctgtgttcatcattagtttgactttgcaatgcagaaaatagacagtctcctccaatccacttaattgtaaatcaggatcttcagctaaggctcagaacaaagatcaaagataaaaaaggaaaaagagaaaccttcatgtccggatcatgctcttatcttcaggacaacttgagtttctttcaggtatttgtaaaagcaagagaaaatcaatgagaattaaggtcggaggagacgaccaataggactgttacaggtttatcatgttttggatgcaaagtggctggtgctcatcctgagtccatcatctgtctcaggaagacagcaaactattgtgcttgtgttttcagaattgcagtggagataatgctgttaacacaatggggcattgcaagaaactcataggcacaaggattgatcacagatattgcttatgggatctcagagggtaaagaatacccttggatgaagagctgcttaaaagatcatggacagttacagcaaatttagacaaagcttggactacaatggaaatccaagaaggttgaagagttctatagaaccatccaggaggcactaaactcgagatatatttattacacagcagaaaaagttgaaaaaggaaaggaggaaggtggtaaaagtgaagtagatgaagaaatctgggtagcctaaaatagtatatttatatactaaaataatacattaaggctgttctttccttgtgttgctggtggagatacagacttggaatacataaaggagcaagttactattattatgtggaacgattaaggtggagaacttcaaatgccacatcaattattatgtaaatcctaatgatgccaagaaactcacattcaactaaagggtcctatgtgtgtggctgaggtaaaatgtggccttttgaagttgtcaataaaggaacaaatagattgttgtgactatatagggtctgatgagccacttaccagcagcttccaagaggaaaatgtacaggcccaaaaaaatgtcacagaactgccaaaaggataggaaatcgatgacataaatgatgaaataactcattcttctacttgctctttattggtgttaaataattgctaaatttttatttgaatggaaaaacagaaggaaattggtgagtgacagctccttcaaagatgatcctctaaaccagtggtccccaacctttttggcaccagggaccagtctcatggaagacagtttttccatggatgaggggtggggaggatggtttggggatgattcaagcacattacatttattgtgcactttatttctagtattattacattgtcatatataattaaataattatacaactcatcataatgtacaatcagtgggagccctgagcttgttttcctgccactagagggtcccatctgggatgacaggagacagtgacaggtcattagattctcataaggagcatgcaacctagatccctcaccatgtgcagttcacaataggacacacactcctgtgagaatctattgtcactgctgatccgacatgaggcagatcttgggccataatgtgaacaacgggaagcagcatctgtattgaacagatgaagcttcacttgctcgcccactgctcacctcctggtgtgtggcctggttcctaacaggccacagactgccaccggtccatggccctggggttgggaagctttgctttaattatgtccaaaaaagtgtatgtcccttaaacaatttagatcatcaccaatgggaaaacagtggatacttctcatggtaaacagaggaaacagaaaaggaagtaagctaagcaagtcatgagtgaaatttactaggcttttgacctgggagagtagttatctgaggaaacttagtgtagaattgactatagtttaccctggcatttggatagctattgttggtgaaatattcacactcgttcatgcaactactttatgacatatgaactctttgcctgctttattttccttagcatttaactttaaaacaaaattttaaaaaaacctaacattgtgtgtgtgtctagatagataagagagagacatagagacatcaacacatagatacaaatatacagatatagatgatatagatacagacacatcaaaatatcagcctatctcagaaaataggaaggggaagaggttacttataatttgaccagaatttagaaggctaagtagtatgtgcccttggagttaatagtagcagtacccaggttgagaaccacaaggaaaagacagccccataaaaaaacaaggactcactactctgctctctcccacttttcaaagtgattgccatttgccctttattgacactcctttgttattttccccagagaaaaataactatgcattattctagcaggtgtactagtaaccctcacttctctccattcccacacacctgaaagttccccttccagggatggggaatcccagagacatatctagggcctctctgtccaggtcctagacagggatctgggtctggattaacatagaaagcccttcacattttacaatgtggatgtgcatggttctgagaggtgaagccagctgagcttctgggtcagatggggagcctcagaacttttgtgtctagctaaaggactgtaaatatacctatcagcgctctgtgtctagctaaaggattgtaaatgcaccaatcagcattctgtaaaatctgtgaaggtctgcggctcactcctgaagtcagcgagaccacaaacccactgggaggaacagacaactccggacgcaccacctttaagacctgtaacactcactgccaaggtctgtggcttcactcctgaagtcagcgagaccatgaacccaccggaaggaagaaactctggacacatctgaacatctgaaggaacaaactctggacacaccatctttaagaactgtaacactcaccacgagggtccacggcttcattcttgaagtcagtgagaccaagaacttactggaaggaactaattccagacacagttctgccatgacactcttcagcctggtagcccaggcaattttgccattgacttttctaggttgtaagacttagctcttccttgaaatagaatgaatcttcaaattgtaccacatgttaatatacttaaaaattaacaagacagagaggtggttagtggctataaggtgttcactgtaaaattcaactttgctgaatttcgaaacttatctattaataataaaaactgggaagtattagcaagtgagtattttggtttttgtggggttttgttcttttgctttgtttcgttttgtttttaccaattctgtgtcattctttatttgaaatgcaacaagaaaaacagcaagctgtcagtcatgccattaacaaatggatgttataaaacccatgcctgtctgggtgcgtttgctcatgcctataatcccagcactttggaaggctgaggtgggtggatcaccagaattcaggagtttgagaccagtctggccgacatgctgaaaccccatctttactaaaaatacaaaaaaattagccaggtgtggtggcaggcgcctgtagtcccagctcctctggaggctgaggcaggaggatggattgaacccaggtggtggaggttgcagtaagcagagatcgcgccactgcacaccagcctgggcaacagagctagattctgtctcaaaacaaaacaaatcagaacaaaaaacaaaaacaaaaataaaaatattattaaacaaattaaaatatttaataattattgtacaaagttacatttatgatttattcctaggattataattattattacattccaaatactgagtcctttctatgtgtcagttaccctgtatgcattatctaattttattctacagccattctatgaagtaggtattataattatgaactgatttacaagtgagttagccaagactctgggccattaaatatcctgcccattgtcctcagacagaggagccatgtgtcaagctcatgtcttgagcacaattccttagatacagcgttataataaactcctttcaagagatgcaatgagtggacattttctctacataacatgtgaataagacacattgaggaatgccattaggacttgcccaagtaaggacagagaggatacactagcaacattttaatccctgattgtatttgaaatctgccaagtacaaaataaacatcaaaggcagctgtggcagccagatgtcttctttgtttcttctcatgtgagccttctccctgctcaagaagcatgaagctaagtgtgatctaaaaggctatctctgctgcccattcattctttggcctttgtacaaacactgccagcagtacatcacttagaacagcacagcacagcaatgatttctataacagaaacattaatcaattaaaaccggaagtaagccagcaaacacattttactgagctcaccagcaagtcatcatcgcatagatcatcagatagaaatgtttcttgactaaaaaacaaaaagaaaactaaactgtgagttggtgaccaggtaccaggccttgttttgtctacttgtgtactagaatattctctccctttctatttcactagtcacatgatgaccacaagtcatagagtaatattttttaacttactgcataaatggtggggtttatcactttagtttctgtcaccttaaaaaaaatatggtttcttcaaagaatttagataatcaccaatgggaaaaaaatgaatacttctcatggtaaatggaggaaacaaagaaggaagtaagccaagcaaggtgtcagtgaaatttataggcttttgacctgggagagtagttatcttaggaaatttactgtgaaattgactatagtttaacctggtattttgatagctcaaagaaaccatattggattatttaaactggaatgatttgctctatccctattttctcaaaggaagtcaaataaaaagcatccatatggttctcatttgcactgctataaaaactcatatttaggtggcatgacactgcaatatacctggtataaaaagcagcatttttgagcactttctatttgtcaggcacttttcagaacagttttttttatattaactaacttaacacataggtcacagtgtggttaagtaacttgaccaaagtcagtaagaggtggacctaccttctcagccattacgttctacttcttaaatatcacaatatgttaaatgtttattcagcaatttaataattttaaaaaattattaccaatttcaaaagcatgagtataatccatttgatattaagataatatcaataaggacgtttaaaaatatacttgtgtaagtctagcctttatattagaaagaccacccccccccgcccatgaccctaggagtctttttagaagtaaagtaagggaggagagatttaattttagtcactctcctttttagtgtgacagagaaacctgaacgttgttacaatggagaattgccctgttgccaattgcgaatgtctccattactgagtacttaggagaagactatggacttgttgatgagataaacatgctcaaaatttgacatgggcatccagttctgatcaacaataatactttctcttattgctcccagaatgccttactccaaatagaaataggaacaatatcagtaaacactcgttgctgtcctaagcatcactttctgccttgatggcagtggggccagccaaagagtcactgtcagctgattgtgggtgagtgtttagacaggattctttaagtgatgaccgtcacaaacacaacccaaaatatctatcaaaaaaaaaggaaatttattgaatcacatagctgaaaattccagaagcctcttgttttagacaatgctagatccagataccaataaaaatcagttatcattagaaatctccctcagctctacttccctctgtgttttattttcagaacattctccatgatatcagagaatggtatcacacccacataaaataatattttgaccaaaagaagacagagatgcccggcagtaggaaatagcagactacagtgtgccatgatttcttgaacgataacaggcttattttcgatggggtggctatcagtgttggagcctttactcttcctggaaaaaactgcagttgcaaatgcctttttctcatccttctgctctcaccttattcttctctcatatcattggcaccagtatatatacctggtcatcaaacccagaattccaatatcatccttctttctcactaagacctttatttctttttcattattattatactttaagttctagggtacatgtacacaacgtgcaggtttgttatgtatgtaggcatgtgccatgttggtgtgctgcacccattaactcgtcatttacattaggtataaatcctaatgctatccctcccccctccccctaccccacaagaggccccagtgtatgatgtttcccccaagagtccaagtgttctcattgttcaattcccacctatgagtgagaacatgcagggtttggttttctgtccttgcaatggtttgctgagaattatggtttccagcttcatccatgtccctacaaaggacatgaactcattcttttttatggctgcatagtattccacggtgtttatgtgccacattttcttaatccagtctatcattgatggacatttgggttggttccaagtctttgctattgtgaatagtgccacaataaacatatgtgtgcatgtgtctttatagcagcatgatttataatcctttgggtatatacccagtaaagggatggctgggtcaaatgatatttctagttctagatccttgaggagtcgccacactgtcttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttgttttgaaaagtgtctgttcatatccttcgcccactttttgatggggtcgtttgattttttcttgtaaatttgtttaaggtgtttgtagattctggatattagcccttggtcagagggtagattacaaatatcttctcccattctgtaggttgcctgttcactctgatggtggtttctttttctgtgcagaagctctttagcttaattagatcccatttgtcagttttggcttttgttgtcattgcttttggtgttttagacatgaagtccttgcccatgcctatgtcctgaatggtattgcctaggttttcttctagggtttttatggttttaggtctaacatgtaagtctttaatctatcttgaattaatttttgtataaggtgtaaggaagggatccagtttcagctttctacatatggctagccagttttctcagcaccatttattaactaggaaatcctttccccatttcttgtttttgtcaggtttgtcaaagatcagatggttgtagatgtgtggtattatttctgagggctctgttctgttccattgatctatatctctgttttggtaccagtaccatgctgttttggttactattgccttgtagtatagttggaagtcaggtagcgtgatgcctccagctttgtccttttggcttagaattgacttggcaatgcaggctcttttttggttccatatgaactttaaagtagttttttccaattctgtgaagaaagtcactggtagcttgatggtgatggcattgtatctatacattaccttgggcagtatggccattttcacgatattgattcttcctatccatgagcatggaatgttcttccatttgtttgtggcctcttttatttcattgagcagtggtatgtagttctccttgaagagttccttcacatcctttgtaagttggattccgaggtattttattctctttgaagcaattgtgaatgggagttcactcatgatttggctctctgtttatctgttattgatgtataggaatgcttgtgatttttgcacattgattttgtatcctgagactttgctgaagttgcttatcagcctaaggagattttgggctgagacgatgggtttttctgaatatataatcacgtcatctgcaaacagggacattttgactttctcttttcctaactgaataccctttatttgtttctcttgcctgattgccctggcaagaacttctaacactatgttgaataggagtggtgagagagggcatccctgtcttgtgccagttttcaaagggaatgcttccagtttttgcgcattcagtatgatattggctgtgggtttgtcatgaatagctcttatttttttgagatacgtcccatcaatacctaatttatcgagagtttttagcatgaagggctgttgaattttgttgaaggccttttctgcatctattgagataatcatgtgtttttgtctttggttctgtttatatgatggattactttacttcttaaatagttttttcaaatcaatccaacttatccctattactgtttctctcccttggataataacagtggtattataattagtctttctgactcctatcttgtcccttcaaatccattctccgtgttgttgccactataatcagtctgaaacacaaattctgccatgccacttccctgctttaaaattatcaagggcttacaattgttgtcagaataatatccaagcgattttacctgctgcgtgtgaatagtatacacttctagaattttgctgcatcaaatgttgccattagctatatgtagcaatgtagttttaacttcaattgaaattaattaaataaaatttaaacttcatgtcttcagcttcactagtcacatttcaaatgcccaatagccacaggtggccagaggctatgtatcacacagtgcaaacatagatcatttccatcttcatagaaagtcttaatagtgctgaggttccatggcctcatatctgtccactacccaactattttcttaaaatagtgctgaacaactggtagtttttgagtgagtcatacatattcatgtctctgtagctttgctccttctagtactgtttggattgctcttcatgtattgctagataatagccactgaacattctttaagagtcagcaaaagtgtcaccttctctagaagccaactctgaaaagtgggcttcagccaagcgttttcaaggtattctgtgcatttgctcacctaaccatatcacagaaatattatctggtttgtgcctgacttcctaagtgacaacaatggaacaaacaaacaaaaatgtcttgttctgtgttgttttatcagcaccaggcaaaatctgtggcatgtagcaagtgctctgatatatgttttctgaaatgtaataaatcatgtaaagaggcaaattaagcattttaacctcattaaacaaacaaaatacctactttaatttttgcaattaatgtaagcagtagctatccttgattttgtacttgtctctagtcctggcctaacctcaattcaactccaacatcatatgtcagcctcagaccatattcaccctagagctgttttcctaatttctttacttacttaacacagggcaaacctaaggaatgagttgaagtaagaggatctaggttgaacaccttttccaagaataacaatacagaaggaaagtttacattgttgtaggttgcctcagtgtcatacattcctcagaatatttttacccacgagagatcatatttcttctttatatgaagcactgatggatacagtatccatgaaaataagagggcccacttttctagagatataacatggttcacttaaaacatgtttagggacgggaagcccagcattttcacttgaaactgttctcttctttttatgtttagatttcccacataccttagcgtagatggaggttcccccacaaaaagtatatatggctacttctccttcttcttcctttccaggagaaactgggagagaagtggcattccaaagggactctgcaagactgtcccatgagctttggtaggttttgcataatttagaacctaatatcccagcaattcagttaaacattttgcatgtcagtctaaatagcatctaaatcttttgttctttgacatttaacatcattctgttcattccagtaaaggttgttgcctttttttttcaatgactttctgacctgtctttaaagtcagcattccaatcagtctccactgacgtacagagaatagtgacatattgacttttacaagaaatgaatcaaaaggtgacagaatatgaatcgatggaaccttagcactaaattttccatataaatgcaagtgtcaactaaacaaagggcttgcctctttgcatagtcaatgctaggtggtttatccacataatacacacttgagtcaaaactctgcataaccttggcctggtgctccagtggaattgtgggtcataatttttttaaatataaagttgacttttacttgaacacttgatcgtttaaattagtcctacccagttctaattttagctatgaaatgatgaatggaatgaaacctcagaaatttccaatacattgcaaaatacagattacttaagttacttcatctttaaacttccttggagcttgctttcgtctgcatttacatgggtattctgatgttcccattatactgctagtactccagcccattagacactcattcttccattgtcaaattctatttcgtgtttcattctgcagagtcccttgactgtttccggttttctctaggtcttctttccataatccaagagacccacaccaattaataagtcattaatattaattataataatgctaatgttagcaagagtttattgtacgtttagtttatgtcagtcactatgcttagaagtgtatccaaattatctcaggcaatcctcaaaacaattccatacagatagtattttactgctatttatccacattttagagataacaaaattgagacaaagagaggctatttaagtatcacatccatggtcacacatctagtaaatgtcaacgctttctcattcaagcccaggactgccaaatttcaaaatccaagctcctaaacagatactcctattccccattctgatgtattcaagtttaatttttgaactataaaaaaatctatttccatgtcacagtgtttaagaatatatcaacaatgtacattatgtcaatcttatcatttgaaaattattttaaaataagacacaaatattagctaatgcacatttacttttccctttctgaccttaatatatttagttataaattctaatctctataaaaccattaccataactaagaaatatcagccaaacattatatgaaaatagtttttttttaagactgtcagttgataacggaaaagaaaggagcaagagtgttattgagaagttatattactgcacaaagtagaggattgctttgtgatagattctctttgaatctgagaagtcattatttctaacagtacatttcagataacacatgcaattaaaatgtcttctttaattatcactaaagaaaattatttcaaaggacagcagcctatagaggtactttgccatgacagacaaacttaacaaaaaggatgaagaaagaagaacgcaatggataaggaatgtaaacaaatttatgaaagaaataaaataaagggtggcaagtgaattagcaaggtggaataagtaacaactaaaagcctacaggatattgacgtaggagtgggaactaaaaacgaaggaaaacagaattagttttgagtgttacatggcggatgaaccacataatcctcacccactctgagcaacacggaaatgatggtctatcttatctccatctggcaggagagaggagggatagtttctagagatacaaaaaaaaaaaaaaagatttttgacctcaggcccgcaagtacagtgaacgtctggggtaaagtatgagtttaaaaaagggcggagatacagaagagtctcaatgccaaatggtagaaccctgctcataggactctagaaaaggttgacaaaaccatgcccccaagccctcctttttttctttctttcttttctttttttttttttgagacagggtctcactctgttgcatagactggagtgtagtggcacaattttgggtgacggcaacctccgcctcccaggctcaagcaattctcctgcctcagcctcctgagtagctgggattacaggtgcacaccaccacaccccgctaatttttgcatttttagtagagacggggttctaccatgttggtcaggctggtctcgaactcctgacctcaaaagatccacccgcctcggcctcccaaaatgctgggattacaggcgtgagccaccgcgcccagccgccgtcctcttaccataagcattaaggcaacagaaaactagaaaaatgttctctggaagaactgaataattacagggaaacaatctttgcatactctcattgagagtccagctgattgtgcaatgactcagcagtgaagtccacagaaccacaaataccccctttgcccatcagtcttcaaccttttaaccaggtttttattctttcattcttacatatgtacagacacgtagacagctgatgaaagccttcaatgtcggggaaaaacaactaccagaaaatggagggcaaaaaagatacaaaataaggtaaggctaacattttcaaaaacctcaaatttatgtcctcaaacaagtaagaaaatgtattgggttaagaggacagtaagagagaaagagaaagaaagaataagtcaaagaaaaaagatagctcttataacttaaaattggataatcaaaataaaatttgggcagcaaagtggaataatagtataacagttgaggaatatcccagagtagaataaaaagataaataaatgaaagatactggaacagtatgagaaaatcaaaaggtaattacaaaagatttgatatttagataacagaaattttagtaaaggaaataaaagcaaaagaattatatatttttctaaaaagtggaaatgttccagattgaaggactgatgggattagctgaagataaacctgcattatgaaatttcagaattctagagattaagaaaacttctaaatattttctgcatggactgaattgtgtcccccaaaattcatatgttgaaaccttaacccccaatgtgacaatctttggaataaggaagtaattaaagtaaaacgaggtcataagggtggggcctcaatcggataatattggtgtctttataagaatagacatcagaaagcttgctctttctcttctccatgtgaagaaacagcaagaaggtgatggtctgcaagacagacagccctcactagaaaccaaatcagctggaaccttagtcttggacttcccagcctccagaactgtaagaaatcaagagctattgtttaggtcactcagtctttagtattttgtaattttagtcccagcacactaatacactttcatagaggaaaaataatcacatgcaaaggatagggatcaaaataacatcagactttccaacagtaactttggatgccagaatacaatacagcaacatctttaaacattgagagataagtgactctgaacctataatcataaccagatatggggttatcgactagaatccagactggggttttccagagtaagtggacatgcagcaagcaattaatctccatcagtttaagtttagggtattttgccatagcaaagctaatgtattgaaaatttatgtcagataattgtatgttctagtcactttaatatttctagtcactgtaatatttccatttctgacataaggtgtaccacccagtaccatctctccctatttctaacaaatatgtagcactctcacataaagtatcttaaaaggcaactttaaatcaaatcatgtactttcattctacactttattggagatctaatatctggacatgcccaacaatccctcaaagttcctcagattttcagttaatgcttaattttttattgtatccaaggtattcccttttggatagggatacagtgatcccaatccgcctttgaatagtttatttgtttatgtatttattcatttatttttgagacagagtcttgttctccacccaggctggagtgcagaggtgcaatctcagcgtcctggctcaagtgaccctcccaccgcagcctcctacgtatctggcactagaggtgcataccaccatgcctagctaaattttgtattttttattgagatgagggtctcaccatgtcacctagactggtctcgaactcctgagctcaagcaatccccctgcctaggcctcccaaagtgctgggagtacagacatgagccatcatgcccagcacctccctctcacatatttgatacttgattaagaaacttgaactcactgtgcagcttagcagcttataatttagctattgcttagttaactgtagtcttgtttgaatgatatactatttcgtcagtactctcaactattttaagtttgctcaaggaagagacaataggttttaatttcttttcagacattaacacaattttaaacacaataggtaggcacaaaataggcacttactaaaggtttgctcaataaattatgtcttccgcagggtgctgtggctcacgcttgtaatcctaacactttgggaggccaaggcaggtagatcacttgaggtctggagttggagaccagcatggccaacatagggaaaccctgtctctactaaaaatacaaaaatcagccgggtgtagtggaaggcacctgtaatcccagctacttgggaggctttggcacgggaatcgcttgaacctgggaggcggaggttgcagtgagccaatatcgtgccactgcactccagcctgggcagtagagagagactcggtctcaaaaaaaaaaaaaaatagattatgtcatgttctccactaaggacatgggagatcatgttcatttacccagaaaataccatcaatgacttctgtgttatagattattaaatattgtcaatattttgaggaggcttcaccctttgtccatgcatgaatctgaatcatctgacttcactgtcatctggtgtgacctaggaatggaaactagttttaacaccagctcaggcagaatataaatatgaaagtaatttcctgaaagaaaactattgcatcctaaggctaaatgttaatgacttcatattttccaggtttatgcattatctcagccacatttccctgttaatttatatattatataatggtagagtgagagtaaacactggagagcacttagtccagcaaagtattttttgcatgagatggagtgacgtgcccagagtcacatgacttgataatgataacagaagcagtggggccagtgtaatcagattccagtgcatgtacctcccagtgacctaagagttggatgatgtcatttctcttgttgaggtttttttttttttttttgtatgtagagatcgagcgccatgtctatcacaaagcatatgagctgatgtttcctggacttaacgtatataacactaaatttcaggaaaataatttagcaaggtagctaaatgcttctgtatataggaaatgctgggtactgcacagcgtaatcaagacattttgtttctaaatctaattctgcaaaatttcccttccatttccccttctaattttctattagaataaagcaataaggtaaaatatattaatcaaagtcatcagttcaggagaacaggaacccctagaattattcaaaccatcgacttggatgaggtagttcacattattaaattaatttgaagagtcattaattaacttccttgcatttttaaatttcatagtaacatgttcaaggatgatagagcattgaacttcattagctgattgtttgactcagtatttatagaagactgctacttattcagaaattcagttatttgtaacactgtttttcttactgttacattttaatgaatctcatgtcttattgtcagactcactcacattcgataaagggtagtggtaggagctatcttttatttctattaatctctttcccgaggttcattagcagggaattctttcctgttagatcaatggcaaaatcaccgtctgaagtcattttgccttgagcaataatctgaacatctttcttggaaatgatccgcgtgcccactggaaactttgagaagtagtttttaattgcatttttgttagattctggtgctgccaagccctgttttgatgcctgagacagtatagaaacaatttgaaatccacaacatgggaagattgtggtgccagtcaagctgactgcacattagcaccaatgttctttacatacaggtttaataatcagaagaagaatcctaagtgtttaataattgaacatgtgtttaatatttaagcagccagatctttccagttgttaaactaatattgaagtagggtgaaagcattctacttactggcaactctccatcttacaaatatcttttgaagttcagtacagtatagggtctatcactataccgtctggcggacagtgttacttatcataaccaggaccaaagacaatgcagaagctttcttcttgtcattacagccatgtgtaaaacttatatgtgcaaaaactatagtcataattaatgattttttttaatctcacattttatgtttttttctttctttgtggctattgaatgcaggaatagctatcctgaaaatgaaaaagaaaataaggcaatgtttacatcaggttatgtgctgggaattatttcacttctaactaatcttcaaattgcaaaggagataattatttacttaaatacttgttagcccagagttttcctgtactgtccacagtgacttaacaattttccttaaggattgttacatattgacaacacttgtagccttagacttcacagcagtggctccaccccaccttccaattgaccttgtacattcttgttgcaaaagatatgttcagtttactgatcacaaggtattttgtattggagcagttaatttcacctacgtgaatatgagccagagggttttaaaaatcttatatttcttccaacaatacctgttcttgatatttctgctcgaaattctgattttaaaatgataatcgtgactttgaaattcactttatttgattgcagccttatcttttccaccaaggattttaggtgactgccatgcaacttagttccagatggccttgaattttcctagtatagcttcttttaaaatttgcatgaggaaattaaaatgactgttttgttcttgatggatacttcaaggcaatcttttagcaaaatctcatacttttgcacaaacttttaaaaacttttaagttcagaggtgtaagtgctggtttgttacataggtaaacttgtgtcgggggggtatgttgtacaaggcttaatatttgggtgataaatttaaactttaaaaacaattaaaggtatcccttatagactagcagttaagtgtggctgctcattagaaatacttagtgaactttgggaggccaaggtggatggatcacctgaggtcaggagttcaagaccagcctaggcaacatggtgaaaccccatctctactaaattcaaaaagtagctgggcacagtggcgcatgcctgtaatcccagctactccggaggctgagggaggagaatcacttgagcccaggtggcggaggttgcagtgagctgagattgcaccattgcactccaacctaggcgacagtgtaagactccgtctcaaaaaaaaataataataataataaatacttagtgaattaaagatgcctgggctccacacccagaaaagctgattcagtgtctggggtaaggtcccatcacatccgtatttttctctttcccactgattctactgcctagcactgtgaactgttacacaataactgatggagaagaatttcatctttaatttttctgttttcttaatcatgtgaaaaggcaaatataaaataatgaaacaaacagttcatgaaaagaattggacagcagagatcttgagaaatcttagccaatcaatacggtcggataagatttatgaggtacgaggccatgttagccgtgactattctccttctccttgcatcatcttactaactctaaacactgtgtgatatttgactttgattctttaatcctttttaatgttgtaatatttcaggactcttatatcaggaaatgcttacttaaattttctccaaatccctcacgtcatataatatttgcttcttacatctcttgtgttgtaggatttgggaaaattctatttttcgccactggactttaattctatgaagttgcacctcatctttccctcctagagataacgtgcagcttacatgatgacttatgaatccataaatgatgttcatttgtttctgcaaactgaaaatatatttacactttggtacttctcttaggtaatcagaatgaaaatttcctagggaagaattttcatttaagtggctggagaaaatattttgcatcagtgaagatgtagtgaagagcacttgataaaatacattgtcacatttatgtctaaggtttttcctgtctaattaaaacagcagagcaggggtgttcacttactgtttcaacttgccaaatgattctgaaagtctgtgacctgtgagtatattctttcttctttctgctgcgtgaattgaaaccctgtgtgcagggtaaggagtgaatcccacttagatagtgactagcgagcagcagcaataaacctacactaaggcgtaccttcaaacatacttattctacttcttctttgcactgttaatactggcctttcctgacttcagcctggattatccattgcctgactgggaaaggcagattgttagaacataaatgaaagaaagagtcagtgctcagtttctgagctccagaataggcccttgaagctccttttgagggcaatctttgtgaaacaaagcttttaatttgccagaccctggctctctaaaaagaatgaacacatttatatctttatagatataaactggagtttcttccacaatgtaggaaagcctcctgttctacagaatcaccccctaaaataataagattttttgaaagaataagatggaacagtaaaaacctacgtaactttgtaatcaaagaactaataaaaataaaaataatcctaacgtaagtaaatattaatgtagtgaaatttccactgaccttggcacctaacatgatagttgatcaaatttttataatataaagttcatacctctttctccaagataaatttctttg

SEQ ID NO: 681 - DNA, 120692 bp, Homo sapiens
atacctgtccagtcatcaaagtctacaagttaaacctaaggaaattacattgaccactctcaagaaaggattgactttccattcatctagtctaacaggacaaaacaccccactgagggcaagcaaaactctgaaacaacctaaaaaaagtcaatggaaaaccaccaagaaacagtcaaaatggaccccagcaacaccaaagccatttcagctacaaagaaaagtccaaaaacatccaagaaaatccagtccatgccagctaagaaacaaaacaacccacaattagagcagctccaaaaacatctcaacctaagaaaaaatctctaaagacccctagaaatgctttgtctacatcattcaaaaaaacaatcgtctaagtccacagcaataaaagcttcccctaaaacctcttcgaccctcaaaaaagagccaactaaatttaaaaatactttgtcttcatctgcaaaacaaaaattaaatcaggcagcagtagctaaagcaatcccccaaaaaacattagccaaaaagaaagctcaaaataaacaaaaaaatatgtggctaactccagtaaaaaaagatccaactaaggcaacagcaatgagggaagcttccaaagccaaaaagaaaaatctaactaaatccaaaaaggcagcacctacacctgccaagaaaaagctaattcagccagaatcagttgtaatgaaaaggaagacacctacagccaaaaataaaatgttaaagaaaccacaaaaaacctttactgcacctgccaaaaaacaaatgaatcagcctaaagcacttaaattagtactaaacacacaaccagcctctaagaaaataccaattaaatctaaaagttccttatctaaaagtgccaaggaacagtcaaatcaggcaaaagatgataaacctccaattctcaaaaacactgtggtcaaaaaaaaaaaaaaacttaagaaaatctaaactatttcaatctacaccagcaaagaaacagcagcatcagataagtccaaccaaaccaggtgaaaaatcagctgtggccaaaaagaaaaatataaagaaacctaaaaagtctttgtctaaatctaccgataaacagcaaaagcagtcacttagcacagccaaaaacatgtggagcaactagcaaactctaagaaatactataaataggctatcaacatctgccaaaaaactgttcaatcagcctaaatccactgaagaagggccaaaaagatctccagccaagaagaaaatcaaaaagaaacctacatctgccaaaaaccaacagaaatggcccacaaaaggtataaagactacaaaaacacatcttgcaaagaccaaatctgtaaaactacctcaaaaaagacagaccacatccccaacagcaaataaaagactaagtaacttccaaaagagacaatctaaaccttctaagaaagatgtgaatcaacttaaaccccttcaaggagtaaaaagacaacctcctttagcaggcaaaatggaaaaacaatctaaaaaaggacaatctgcatttcccacaaaaagattaaaattatctgaacaagaaggatctaaatctgttcaagacacatggaaaaaggtccacaaagcaaaaggaaacctttccctaaagtcacaaaaacactgttatcacattctcatgcctctgttccatctaaatctccttctccgccaatactacagccagctgggtcacatccccatgcacaccaacatcatcatcaccaacggcatcaatcatttcataaaccacctttctgtaaaccaaaacctcagaccagtccaacaggcattacaactgaacccaccagtgtaaataatacctcaactagtacaagcaaccctgtacctagagtcactactaatttagccacaatcactagtactttatccaacagcaaaatgtctacgtcagttgctccaactagggcaactgccactactgctaagggactagatggaatcaccagaacacctcaaaccctatcccctgtcactgtaaccccaatgacatcaaacactaactcagaaatagctgctgtatctacaaagccggcatcaactgcaactgtcccagcatctgtgttggcctcagaggcaccttcagtggaatccacacctcaagggtctgctgcttccagtgcctcagcccctaccaacccaggaggtggctccacaaccctgcaagcctctgtctccaccattgcctctgattttaccacagaggacttagaaactgaagcaaacacagcagaggacatcaccctctcggccatagactattccaccactcaagctgcctctacaacttcagcaaacacaggttccacataccatgccattgctggcaccactgctgcagccacagcttccacatttgctgtatccacaactgcaacaggtaccacaaccctaaggatttgtgccactaccagtggtgctgcctcattgtcagccagtgctgccacaactcttgcttctgttgatacagaaacacctggaatttctaccattgcttcttctggttctattacaatagctgcattgggtgccaccaccacaactgcagctggtgccacaaccacagttgcaccaagttctacaaccacaagtacacctgacactgccaccacagctgcattaagtgccaccatcacaccagtggatgagactaccactcaaacagtagatggcacaaccactaaagctactacctcagtggatgaggaaaccactgagtcagcagataatacaacttttgtagctgcctccacaacaccaattgatggcatcacaactggtgcaactgactctacgaccaccagtggtatggctacaacttcagccacagtgctacaactgctgctgccagcacagccatatccggtactgccacaacaactgaacaaggtgctacctcttcaacccctgtgacttcagcttctactgctgagcctggtgtgttgaccaccctgagtgaaactaccacccagggttttggagcttcaactgcagaggtggagactacctccaaaccagcaaatgacacaatcaccgaagctgtcaccactcaggccaaagatgccacaattgaaccttctgccacaacctccatagctaaccctacgtcctcagcagcagactccacatctccagctaccaggacaacagctattgcaactacagccataatacctgtaggatctaccactacaaccgtagaggcctccacaactccagtggtttatgtcaccacaagtgtcactacccataccttcaggcactggtaacacgtcttctggtaccaccacaactgtacagggtggtgatgccacaactgtattaagtgttgccaccaccttaccaggtacttctacctatactgctgaatctgattcactgaccagtaacagcgcaactaccaccctgacccctgatgctacaagtccaggggacaatatcatcaataaaactgcagatggcacaacaactgagttgccatccctccagccagagaagctacaactccatctactgaggccacaaccctctagctgccttcacaaccttagaagcaggcaccccatctatggctatacttcaacagctgctttttctacaaccgtaattcctgtagcagccaccactgcaacaactgcagcctccacaagtgttgccatcaacagtaagccttgggtgacacaactactgccagtatgattgtaccaggtcctgccaccacaatcacagttactgctgcctccagtgctgaacctgcttcaattattgaagctacaacttcaggagatgaggccactactgaaggaagctacagtgctccagctatcacaatgacagcagcaacaatcacacctaacagtgactccatcaccactgccctagtggcagccaccagtcccatgactatggtcaccacaaatacagcctcatctggaaccacctctgctgcactatctgctgctataactgcagccagttctcctacaattggcattaacactgcttcctcatagtgaaagcaatgctaaagttcatctcaatcaccttgataaacaggtaaactaatgcatgtaaacaattagaagagaaaaatcaaaagtgttctatatatgcccaaatacattgcataatagctagttattcctgatttgactaaattttgaatttccaattgtgtgaaagagagcaggtactcttccaatttatatgtaagaatacagaggtatgggatgtgcccaaattcagaacacatggtggcaaagtcaggactagaaaccaaatttcttaatactgaagcccactgtcagaaagcttagagttctagaatagtgattgcaaaagacagtttagtagatagttgaatcaaaatcagttggcttctttttcaatataattattactgagctctaccactatagaaattatattctttttttttttttttttgagatggaatctctctctgtcgccaggctagaatatagtggtgtgtcctcggctcactgcaacctctgcctcccaggttcaagcaattctcctgcctcagcttcccgagtacctgggactacaggcacacaccaccacgcccagctaatttttgtatttttagtagagacagggtttcaccatgttggccaggatggtctcaatctcttgacctggtgattcacccaccatggcctcccaaagtgctgagattacaggcatgagccaccgcgcccggccagaaattgtattcttaatatgatcttcagggagacaggggaatctgatgaccttatgagtgtgaaaacactcacctggaaggtactgcagaaggggaaatcagcatgtatacaagctcaaaccagaatacgttaagattttgtattcttgtaagtcaagaaattgtaagccatttcctagacgggaatatagcaagagttaaacctcagttaaattcagatgtaaatgagggcataattttactattaataacgaagatttgtggagaagaaaatagaattttgtagacatcaatatacactatatacatatcttgatgaagaactagtctagattatagaacctaatctaaaactctaggataaaaagagcattcctacgactatttcaaagaaagaattgctggaacgtattacctatcaaattttacataaagttttttttgttgttgttgttgttgttgttgttgttaaaagtgggccaggcgcagtggctcatgcctgtaatcccagcactttgggaggccgaggtgggaggatcacgaggtcaggagtttgataccagcctgaccaacatggagaaatactatctctacttaaaaaaaaaaaaaaaaaaaattagccaggcgtggtggcatgcacctgtaatcccagctactcaggaggctgaggcagaagaatcgcttgaacccgggtgacagaggttgcagtaagttaagaccatgccactgtactccagcctggtgacggaggaagactccatctcaaaaaaaaaaaaaaaaaaaaaaacaacaagtgaacaaaagcattctaggtagtaataataatgaatgaagccttaagtgtaactagatgcgctttacccttagcataaaacacataactagatgtgttttcctctaaaatacaattatgtgctgtcaggaaaataagaaaggggtgctaggggctgctatacagaatgtgattcatttcagataagaaatagaaaatagccattttaaaatgactagttaatgcttataggactgtatgaattaattgtacatttctcaacatttttcaaggtcttaatatggctcaatattaaacttttcttgctaacttttgccaacattgcctcaagaatttgctatcataattcttcagaaatgagataattctaaaaattatgcttctttcactctcttactttttaaatgtgtttatttttacttcttcagcttttgttcaataaatcattttgaaactcatttgttccctgtatgcgttttatcagtcccacacatctttggaactagattaaaagtttcatatgctctatcagtcccacacatgtttggaaatggattaaaagattcacatgcttgtccctttaaacagcccccaataatgagcaatacttaaatataagattgaccaaggccttcatgtgcccctcagcttgattaaagtttagacagatttcttcctgattctaggcctctgacctcccttttattacatcatttctttagaaaacttacaataggaaattatttctctgcccctttgagatgtaattctttttaaaagcctcttgtcagctttagaaccaagaataagtctttcttaaggacctgggagccatctctttaaaatgtaaccattaaagaagatagtgcccccatcttccagtctctatgggagggtagaagcctaactttaacagataccagttagcaaacacagatggtctaacgacagagaaaaacatttgtaaattcaaaaatcaggcaatgtgctccacccaagccattggtcagtgccctccctgcaagatcctccaatacttttctcaccccagtgttaaaaaacctcccaccgcttgtttcattagacttgactattgtaatagacttgactattgtaataactttgaattaagtcatcctcgactgataaactttgtcctgcaatttttgctttgatgaaataactgtgtgggctgcagaaaccataggcaaataaaatttgggttaaaactcccattaaccaacctccacaagaagatatcaaaggaatgaaaatagaggatcatgcctactaaaataatatgaaatatctgtcccattttgcctacttttaagggcatgggaaatatatataaaatttttgaaactgatacattataaattgcttataataaatatacttttaaacgtataattgactttggtgcaaaataatagtaagggaaacccccagcacaaaaacaaaaaggaaacaaaatccagggaggagaacatgtgtagggactcagagactgccctgaagggcaggcttggcctttttaatacaggatctcgaattttaaaaccaagatgaaggcaaaagacaggactttaggctcacttcaggcaaatagttggaactaagattctccacataattctgggactcttgggaagccatgtccctcatatgcactcaaagacgtttgattactggtaatggtaaataaaaagcaatgtgctgactcacttgagctctgaaaattaaagagagtttaaaagacaaagggcatggattgataatgcctaataacattctcccaataaaacaatacataaaggaaacaggaaatattcaaagacaaaagggctaagaatcattcgaatttttattgaagtcataaacatgtaaacatttttaaaaataaaacaaggagactgtatgaattttttcctcaagcaagacctgttgtagtgacagtggtggttctattggaccaggcctttcctaggggtactctcttcataaataaatcaaatcagaggaataatgtggccacatcacagacactgaagttttgcccagcttgtttatacatctaaagcactctcaaaattaccatgtacagttcaaaacaaacaataataatagctgacaattagtgagtgctcgtatgtactaagcgctatacattatcatggaatcatattagacattaacaacaactcggtgaggttggttctattgttagaccctttttacagataagaaatctgagtcttggaggaattaagtgttttgctcaaggtcaaagagctaggaagtgaaggatctagcacttataaaattacatctagatttaatgtgaaatgcatgaaaaattaacacacaattattttagttgcatacaacatcttaggcatggaaaaattggctctaagcatgtgaagaagttgaaatcccctgaaagaaatgggcatataaactaaggttgttttaatacataatctaaagcaagcagactcagaggattatactggatactagatattttctttccaccaaaagactgaaaaagacagctgaatgtaaaagaaagtacttcagaaaaaatagcactatgaaatttatacttagaattttcatttcctgaaaagtctgaaaagtttacatgattgtctttgggaggtattatatcaacacctaggaggccaaggggaggccctctgacctgaggacctcctcaatgtaacaagaagtagataggacttcttttctacaatttaaacacacaggaatttttaaattgaattcccattaaaaacccacatgaaaagaagtatattgtaacatctagtctttgttggcatggacattaaggaaagggtgggagggcataaaatgatttattctgggtgatgggatcattcatacaccaaaccacagtgacataaaatttacccatgtaacaaatctgcatatgtgcccctgaacctaaaataaaaaaggaaaaaaagaaaaggcggacacaatcataggtgcacaatccagttaacttttcaaattgaacacaccatgtaaccagctgctacccagacgaagaactacaacaagccagaagtctctcacattttcccttccggccattttccctaaacaaaagataaatagcattctgacatttatcacttcatttctgagttgcagatctccattttcagttgcttttgaacagaacatgtccacgtagataccatggaaacatctcaaatgctacatgtttgaaaaagagtgttatctttgccccccacagtctctgcctcctgatcccctctcaattaacatctatcatccactcagctgcccaagctacaaatctcagcactatcttcaactcctcttctttatcatcactattctattggttcttttctattattttcttggttttttataaatgatactttctttttatccaaacttatcctttcagagctttatgatgtctgatttatattgcgtatgtaatagtctgcaaacaagtcttcctgcttctaattaatctaatttcttctcctcacggtaaagatcaagaacagctggaacattaaggttatcacaataaggcaacatgactggtgccaagtgagctatacagaaagaaaacataaggtctgggagctattaataccaggaaacagtattttatatggcctttaaaattttagctttatctttattaagatgaataaccatcagaggctttgagcaaaagagtgatataatctgactaacatttaaaagaaacactatagctgcctttgatgataacagagagtggaaacaggaaactagttgaaatactaaagcaagtaatcaaggtcaaaattgatggctgctggaccaggatgggagtggtggtggagctacgagaaatagtcgggctctagatatattttgaaggcagagccattaatatttgctcaatgactggattgttgggtatgcaacagagtaggtaaaaatgactccagaatttttgacctgataattaaaaggattaatttttaattatcatctattagtgtgcttgggctgccaggacaaaatatcatagactgggtagcttaaaccatatacatttattttttcacagttctggagattacaaatccaagatcaagatgctggctgattcaattccggatgagggatctctttctagcttgtaggcagcttctttcctgctgtgtcttcatatagaatttcctccaataccttctaaaggtcttatctccaagtgcagtcacattgagggttacaacttcaacatatgaatttgtggggggacacaattcagtttatagctgttgccaacaaatgagattggaaaaactatgagagcagtttttgggatgatattgggagtatatcagaagttttgttcagctatgccatagatctacctattgacagaccattgtctctattaaataaaaagatagatataatatctggagtttaaggcagatgcctgagctggagatattaatttgataattattatcatttcaatgatatttatagttagatatgtgtaactaaacaaatttgtcaagggagtattaatagagaagggaggagattcaaaggctgaaccacagaatgcttcagacagaagagaagatgggggaaaacaacaaagatatgtgagaagaaaggtgagtgaagttgaagaaagaacaagatggaaaccaaatgaagaaaatgtttcgtgaagaaaggcaggaccaactctgccaaatgcactgataagcaaaatgaggtctgaaaatgacagcttgattcaacaatacaaaggcttgagcaattcaaagagaactactagagcagtttaggtagagtagaagttgctttttgaagtagattgaaaggaaagggaaggagaaacttgagacaagtttttggagcggctttgttataaaagcaaagaaatccgcaaacagggataatttgacttcctcttttcctaattgaatgacctttatttccttctcctgcctgattgctctggccataacttctgggattgtatatctagaaaaccccatcatctcagcccaaaatctccttaagctgataagcaacttcagcaaagtctcaggatacaaaatcaatgtgcaaaaatcacaagcattcttatacactgataacagacaaacagagagccaaatcatgagtgaactcccattcacaattgcttcaaagagaataaaatacctaggaatccaacttacaagggatgtgaagaacctcttcaaggagaactacaaaccactgctcaataaaataaaagaggatacaaacaaacggaagaacattccatgctcatgggtaggaagaatcaatatcgtgaaaatggccatactgcccaaggtcatttatagattcaatgccatccccatgaagctaccaatgactgtcttcacagaattggaaaaaactactttaaagttcatatggaaccaaaaaagagcccgcatcgccaagtcagtcctaagccaaaagaacaaagccggaggcatcatgctacctgacttcaaactatactacaaggctacagtaaccaaaacagcatggtactggtaccaaaacagagatgtagaccaatggaacaaacagagccctcagaaataatgccacatatctacaaccatctgatctttgacaaacctgacaaaaacaagcaatggagaaaggattccctatttaataaatggtgctgggaaaactggctagccatatgtagaaagctgaaactggatcccttccttacactttatacaaaaattaattcaagatggattaaagacttacatgttagacctaaaaccataaaaaccctagaagaaaacataggcaataccactcaggacataggcatgggcaaggacttcatgtctaaaacacccaaagcaatggcaacaaaagacaaaattgacaaatgggatctaattaaactcaagagcttctgcacagcaaaagaaactaccatcagagtgaacaggcaacctacagaatgggagaaaatgtttgcaatctactcatctgacaaagggctaatatccagaatctacaatgaactcaaacaaatttacaagaaaaaaacaaacaaccccatcaaacagtgggcgaaggatatgaacagacacttctcaaaagaagacatttctgcagccaaaaaacacatgaaaaaatgctcatcatcactggtcatcagagaaatgcaaatcaaaaccacaatgagataccatctcacaccagttagaatggcgatcattaaaaagtcaggaaacaacaggtgctggagaggatgtggagaaataggaacacttttacactgttggtgggattgtaaactggttcaaccattgtggaagtcagtgtggtgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatgtacaccatggaatactatgcagccataaaaaatgacgagttcatgtcctttgtagggacatggatgaagctggaaaccatcattctcagcaaactatctcaaggacaaaaaaccaaacaccgcatgttctcactcatagatgggaattaaacaatgagaacccatggacacaggaaggggaacatcacacactggggactgttgtggggtgggggtgggggtagggatagcattaggtgatatacctaatgctaaatgacgagttaatgggtgcagcacaccaacatggcacatgtatacatatgtaacaaacctgcacgttgtgcacatgtaccctaaaacttaaagtataataataataaaattaaaaaaataaataaacaaaagcaaagaaatcaaacagtttctagatggggaagtaaaagacaagaggaaaaaatgtttgtttttaaaatttttcttaagataaaaaagagcaaaatgtctatatgttgataatgagccaacaaaaagggaaaaattaataaacaggagaaatagggtttctgaaatgatgtctctggatatgcaagaggggtgggatctagtctgaaatggaaggcttgaagttaggactacctttagagaactcatctatgctcattgaaaggaagacaaaatgtaagaattcagattataggtgacatggaaatagggtagtagagcttgtgaatttttttttatttcatctatttactcttttataaaataaggagcaagatcaccagctgagactgaggatgggaaaaaggtagtggaaacttgaagagagagaagctataataagaagactgaaaaataatggattagagttcgggcgcggtggcttacacctgtaatcccacttgggaggccgaggcgagaggatcacctgaggtcaggagtttgagaacagcctggccaacatggcaaaaccccgtctctacgaaaaatacaaaaatattagccagacatggtggcgcgcacctgtagtcccagctacttgggagggtgaggcaagagaatcacttgaacccaggtggtaaaggttggcagtgagccaagatcacgccactgcactccagcctgggcaacagagcaggactccatctctattaaaaaaaaaaaatggattaaagaactttaatacagttaccagtcagcattaataggtgccttcaattcatgatgaagtatagttttagttttctgtgggtataggaacttagtgaatgaagaattaaatttactctggatagatattttgccaagcaagcacaataaagcaaaaacaaaacgagggaattaatagtgtgtgcaggcgtgggattataatgattgttcatgagatataaagcgagtaaggactcagagggtgtaaggaagagtgaatagttaatagaattgatggattgtaggtccttgtgaattaaagaattattaaaatcagggtaacagagggaggttggaaattgagttgtttctaatagggactattagtagtagcattttaaaatatgggcattggaatgtgtggttacgagagtggactatcagtgtacaggagaaaagaaggtcaaggaactgagatgacaaaataatgaatgaaaccaccttttatgtgaacattgaaatcactatgaattgagaaaagaatgatataaagaatagttacagtgagccaggaagtaaaatctttacaggaagaaagaaaatgatttgagtatcactagatgactaattggacatgtcatgggaagtatacaaatgatacaagagtccaagctggtggaaatttggagacagacacaaaatgatccaaagcattagtaaagaacaaggaagatatctaactcacctccaggcttaaaggtataaaaccatcaaaaataaaagaggctagacttaacatagttacaggtaaattcatgtcttcaggttgtaagagctaggttttaggcattgtacgtcactgaagacagaggaaagtcttcagaagttggtggaaggtaagaaattagtatagaacaggatttgcagagcatttttggaaatacattatgagagatgcatagtgactaggagactgcctcttcttatggtgactgagattaacagaaataaagggcttaatgagattagtcttgatggtctcaaagcagataatggtgttgagtgtggggcttggaaggaatggaagtcttgaagtcttgaattcacgtttacatattgtgattttaaggacaagtaattgtcagtcttactccaagtgtataaaactcaattttgaccccagtgagtacagtgacatggaagagggagaatttacttgaatcagaattctcagggcttcctttagagccctgcttatcttactcttgacaccaggcaattgatgttagcaagaagcggggaatcagacattccctcttcttaaacctaattagcactgaagagttcttgtctctgtgctgttgttgttgccttttacttacacataaaaagttctttctaacccaactccaggtctcaaaacttacccaaatttcaaaattaagaacatttccaaaataatagtgatttctacctctgttgaaacccacaaattaaaatgttttgattatgtaactcgttggtcatattttgcctgtcttgctcccaaatactgcacttgggttcttggagctgaaccttaaagttaataggcactcaattagtattcaaatgaatgaataaatggcaatgaatatggctatcatatgcaaacctttcctcctagaatagattataaattctttgaggataaccattgtatcttccacttctctatttccagaagtgcctttcacaaacacttgataggtaattgttgaattgataggcattcttattcattaaacatgtggtactggtgaggttggaaattcaataaaacaaaataagcattctgggaaaatcagttaagtctatgcctgggagcttacaggaatcactgctagatgaggacaccatcatctgtttcctaatctgtagctcctcttctatattattttaatacatgaaaatgcactggtgttaacctacctgagcattgcaagggacaatttccacaaatagtgactagatcataaactggaaagcatgtgggaatataaaagagctattcacctcattgaaggggtgaataggattaggacttcttgggccattaaaaaaaagaatttcaatatgaaaatttttttaacataaaaagccttgattttattgttccagattctatttgaaaaccacaaagtggaaattttagctatcttagatcttataaggatgaattagtgccagcaagggattctgtgtctgaagatggtggcttacttgaaaagacatgcaaatattatctctaattgaatgagcattccatccttaagcatgtatgattgcactggctttccaacaattactttatttctttgaagagcaatatttaatgtcatgggaatggtatttccaagctactaaagtaataacattataattgttcaactcataacacattacctttgatctgaaggtgattattatatacatagatgctttataggtgcctgattgaaaaaacaatccagtgactggcttgcatataattttggagatatggtatttgttctaatgtgtaataaaagaaggtaaactacagaaaggtattaagatgagccagaagatagggaaaattgaagaagccttaaaaaaaatgacaaaatgttcgacctcatttgcttttctagctggtaagatccatatatgcaatcattaataaattttagggttacattatgtgaaagaagtatatgggttttttaaaagttgcatatactataagttaaatttttgctgtaatgaaatgggaagggataacaagccaattaagttccaactgagtctctacattgtctgataaaagtattgttgcaccatgccttacatagaaatagctgaaaatcactaataccttaaactcagatttttatggaagttttagaatacataccaatggatcatctcagcgagtgactcaataggtgtgatgtatttttgtttgtttcatgtaaacagacaattatcttcagaaactggagataaaagcttgttagtagtgtaagtttactgagcaatcagcaaggtatctataaatcacccagaaaaaaatgtaataagccatgcaatagtctattaaacagcctttcattttttcttctcatatattataaatatatttttcaaacactcaaccaaatgtaattctgttctttaaaaaactacagcctagtacagtgaatcctcatgtaaactaataaatggccatagatgtaaaatgctattacagtgaatccgaattttgcagtggagcagaggaagaaacacttttttaaagaagtaaaatgacactagagctagagagttaacatttagaaggcttcataatattgaaaatatgagccttccccctttcaatttgaagataagcttaataggttcactctgtacctaagagctgcatgcacaaaagacaacagacatttcctatcctctcttttgttaggggattaactcagaagcaatcctttatatgtgaagctttttctctcccccactgaaataaaggaggaagaaagaggaagctgtgtttctttctgagatttaggctttctcagcctggatttcatcttcatgcattgctgaacaaggctgatttggtgaagagttaatactagaaggcagctgaaggaaagactcctttgcaaggtaaatactagaataaatcagaatgtttggagccattctttttcaaacacctaccctttcttaaaacgcctttgtatagggatctaattgggcagactttgttaacttgtgtcaaaatggcctcctaaaaatgcaacagataggtaattattatgaatgtgaaaataagggtgaatttatatgataaagtcctcaccaaagtattctgtcaaaaatctatttgctagttatactgtttactccttgatactctataagctatagaaaacagtcaaaattcttcctattcttgctgacgagataaaatggaatgggccttagcaaattgagtattccacatactatcatttctaacaatgcactagaaatatctgggtaatgtctttatcttattaagttgatatttagttaatgttaacaataataaaacataatcccagaatatataaggagcttaaacaaatctacagcaaagaatctgataatccaaacaaaaaatagacaaaagatttgaatagacacttctcaaaagacatgcagttggcaaaaaggcgtatgaaaaggtgctcaacctcactgaccatcagagaaatgcaaatcaaaactacaattaaagtacaaattatttctagtatttttaaattgtcatttataataactccgtggactaatctaacagagaataatcttacaccttactttcagggaataaatcacaagacaagatgaagatcctagtcctgactgtgaccatcttaaattttgtggtttactttctggtaagtttcagtattttggataatagtaattagatgcagggaaaaaattaatatttagatcatcagcttacatttaatgcaagaaagaacattttgctaaataacacatcattttgttaatattctattttatatttgtacatttccttcttttaaaattaattatatacacagtgaagtaagataagagaagttataatgtatggtagtataggatttgaaggggcttctctatgctttttatattataagagattctttactgaaagtttgccatggaacatctgaatttatactcacagagggtactcaaccctaacataaatatcagctgttcttttttacgttgatattgtgtatttctaacttaattagtttaacaatcaatggataaggaagaaagcagagaccttcacaatgttgctttatttgatcaatttaatgctgtatattcatttcagatttttagtaaaatatctgctggggtaacctcacaaaagtgttgtacctcttcctttttagtttaataggagtcaggaaatacacagtcaaacaaatcaagatttgtctgccaatctgcctttgtcctcatcagacagctatccagcaagttcagtctcatccatcataaaaacaaaaataaattctgcacctacaaaagattcagatagctactcagggtctactgatggagtaagaaggctctctgaattcctttcagagagaaactactgagacacccttcaagctgacttatataactttcttccactcggagatgatgcactaagtaactctatagctaaccagacttcaactagttttgcttatgtcaaggttacagtaagcaactcaactcaggcagaggtttcaaagagcaaagcttcatcttcctctgatgctatgcaagataattccgctgccagtaccacaatttccaacttggcacccaacaccttccacctgcacataatttcaagtaccttgaatcggaagacagtggctttgaaaggagtggatttgtggctgcagatatcacaaagtctctattacaatttagtattatacctactgctgaagtaacaataagtgacagatactttactactcctggggaagaaaatgatgttctatatgatgccactaatcctacaggtgaacaaaataacactttaagccaatggctaccaaaacaatggttaatggtttaggtgaaagtgcagcagtgaaacagaatgtgaaagcagtagatggcactgtcttccttccacctagcatttctatcccccaaactggaagaacgtattaccctagacttcctagcatatactataatgtaatcactgataattcacttactgccaccagaaagaacccaaatgttgcctggaacaccatcaaacacaaaccatcacttttcacaatggacaagtcagagcctgctgatttccaagatgtctatcaatcccctattgccatcacttcaagcaaggttaagagactagccaataaaggcaaaatggttgagaccaaaataaatatccctcttgctattcctattggagctgacaacatttcttatgtggataaaaacactaaagttgcaacaaactgggcttcaatagctgccacctcaccaataaagaaagacattctgaccttgaatgacgttaatactcataataataaaccatataaactaggagatggccttaacagttccagagaaaatcctaacatgtctagagatgatggtaccttattaattgctaattcctctaccattatgaagtcggttgcccctttcattcattctcaagcaacaaacttggtgaaaaagaactctttggcagaggtcccaaaacttgtttttataataaggctaccccagaagctttgacaatagccatcatcactgtctctcaaggaaatgacaccatattttatatcccaataaatgaattggaaaactttttcaaagaagatataatattgaactatgaagcagtttcccaaaatgaggtaagcattatggtagaagaagaagacacacttgaaaaaggaaatgtcagggattatatttatgctatacctattgcaggtgacaatgttcctaaaggtaacaacttgtcagctgaacagtattctatcaactgtaatacatatgactccactacattcagaggaacaaccaaaggcagagctgaccgacctgaatttgagaattcttcatcatcttataaggctgaaatctcaaaacctctacttggaaaatttactcccaaagttcaaagaaaagtgattgtaagaaatagcaatagcggttctgatcatgatacatcctttggtggtgatatactttatccaataatgaaagaaaatgtcccagaaggatatatctattctcctgaaagagactttaccattacaacatcagattttagtattccaatgaaaaataatgtaaatcctgctctggaaggtactgcattactcagtaaaggaactttcagcaatcattattcatcctatactgatgagaaaagtgatccagcaacaggaaaagacaaaattgctacaggtatcataacaaactctcatacaggcatcatacctgtgacttccttcactactgttccttctaaagacataaataaggaaaactattaccatatatctgaaacaggcactcctctctcactggaatatgaaaacaaaataagagatgattcccttatttttcagcttgggactactctggcaaaggaaaataatgtggataatatggatttggtcatcatggaacctgatgaaagtagctctgaatatatttcaaacaagtatgtctttgaaatagaaaatgaagaaaatagccctattgtaaatgctatttcatttacacatgaacccagtagatttctatcacatatacccttctccaatcatgaggcctcaaggagtcttctgtatcaaataactcaccctgagtttgaaactaaagaaaaataccaaaccattattattaaagaagaaaactctgactctagtattgttgcctcttctttcaaagattataccaaaaacttcaacactcagcatccgaaaaccatggctccttccctaattgatgcaggtgagacttcttttcctgagtttctagaaagaacatctgcaggaaaggacactctaagtgcagatgatgccaccatcattttccctgaagtttctggtttagaaaatgaaaaaatcaagtatttctttgtacctcacatggagacaattgttaccatgggagagggcaggacattgggtgctatccctactgatcatagtgtggtgactacccccataaaaactcaaggtcatttctacaggaaaggcatttcatccaatattcctgacacagctgccctgcagttggcagacatcatcacactggagaaatccaaactcaatgaagatgaaatggatttagctgaagtgaccccttcaaaggatcatgataacccattggctcaggttgttgcctaccaagtggggactatctctgatgtcagtaaaattaccaacagtataatcaaagcaaattcaattacttctcttaatctggttaatgacaccaaaatgccaccaaaggccagcattgtttcacttaatgcccctgcctttgagtctgacagcaatgacaataatgtcactaccatgcctaaggtagatggtgtcagctccataaaattaagatttctattaattccctatcaaaaagtaactagaatggcacttcctcttggtgaaaatgatgaatctttatctgatacactggtgacattagaggtatcagagccactgggagaacactctaccatcaccaaccaaaactgggaaatcaccaaagcacaaagtgcctttcagccttttcccatggtctttcctattcctctggtagatcctgctactttttcagagaaacccataaatgtagccactgacatacctaccactgaaaatgaggtcattaatgataaaactaacaccagggtcttttcacctaatatggtccttcaacctgtaatccacaaaaatgaaggaataaataaaactcctaactatgatgtaaatcaagcagttattaaattttctgcaaaagaaattgctactgcaggaactaaggctaatgcattcctcaatagcaataaggctgttgcagaagatgaattctatatttctgaagccaatattccagtgaacttaagagatataaatgcagtgggagttgatcctttcatccttaagcctgatgcggcttctgctgaacagaaagcacctgaaaattccaaagaaacattttaccttgcttccacaatgagcacaacaaagcagacaaagatcagggttaggggctcattttctcttgataatgattacttagagaggtccatcacaaactcttatgataaagtgtatcaactacccctgaaatcaactcttttgcccactaattttattgaaatctataattctgaacttgcttcagcactcattataggagagagcaacataatgactgatgactttatcatatctaatgatataattggtctatctgacgaagaaaccatttcacctgacaatatcatctttattgaaaacatgaacaacataaatgtaaagagatatgtagcttctgtagaaaaagataatgtaactccatatgaagtaatttctttcacaaatgacttgtcagcagagccagatgtgttttttccaacagggaaaaacaatccaaataatatggatctaattaccactgggctcgatgatggttctctggactatgtgtcagagagaaatgcattttatattggaaaagaaggaaagagccccaaatcaaaaatacctacctttgctcaagacaaaaatctacagagtatttggatctcatactcccttatctactgcacatgtcactgagaatccattgaaaggaaatcctgcagaactcaaaactaaacaaaaataccaaatgttgagctccagagaagtaaaccctgattctgacaaaggttatttctttctcaaagattatattgccaagccctatggaaagtcacccagaatgatgattcaccccctagtagatgaaaatagaaatttttcttcaaagttttcagatgataaaactctggaagacaacagcccaagtggaagtgacatcatgattattcttcatgatggtaaatagattgaacatattcacattccagatccaggagcaatggtaaccagaggagaaagcaggacattgccaagtgaaatcactgatctcaccatgagctcaactccagtcgtaaacagagaccactcctacaggagaaacacctcatccactgcttttaacatcctgaggagagccaaagccaccatgtcacccaactctgagtatcataagaataaaactttcaaggcagagagttaccattcataggatgtcactattccttcagttgcatttaatgtcaaccttgataatgaacttccctttgttgatgaagattctgaagctaaaaaacacaaggactcaacatcttcttcactgatggaaacgactcacactatggctgatactactccttttttccatgagaacagttatgaagggagtgattatatgcaatctgatgaatacaatgtattgtctagagaattcccctttctacaagcaactgaaagtgtaatcctcagccctaatgcctttactgacaattctgtcctaatgagagataactccttggctgactcttcagtgtcaatatcagtagtatcagaggcagtgaccgaataccttgatgtcattaatggaactgatatttcagaaaatcaggtccttaaaattcaaacagaccttcagccccactcctcggacccaattattccttctacaagttcaacaactattaacaggaattcaacaaatggtgatgttgattcattatccactgtgaagagagaaactgttgggatttctaaatttaagacagatgctcattctttgggtataattatgagaatactttcacccaaacaaatgcaccctttcccttccaaaataaaagaaatggctaagcactctgttgaggaagacacagcttctaaattcaacctaagtcatgttacaaatgtaacaatcatcattccaactttggaaaaagcacttcctttaacctttgagaccagcacacttcggaagagcaataacagtgaggaggaggaagttattatttctgaagcagacaatatttttttaggaaattcaagtactttgaaagataattttttcactggtaaatttaatatttctgctggacccaaacttcttcccaacttaaaaataatcttttctgctgatcccaccatgtctatggagaagactttaaagcttaagtctaacaactttgctcctccagataaagacacaggctcagaagttttgttccataattcttccactggatcacacggccaagcatggaaatcaaccctttctccttctggtttcacatcaacagtgaggtcatctaaatattcagaacttgatccatttgtcaaaatgaaaaatgatgctacaacaaagactaataattttccatttgaggaaagaaatacttcaactcataaaatcatcatttcacctggtaccaatactccaacaacaggaacactgaatactatttttagtaaaagatttccacacagaaactttgcagagaaagatacaatcctattacagaaaacatattagatattactttaggtgaaaatattccaaataatgaccatgtaataatcactgtgcttgatgacagagcttttgagaatgtcacaaatgaatatgtcctggaacaacaggagagaaaatacaaccctattattaaaaaaaactcctctcacttacaacctcaaactatttggatctcatgcattctactctagtgctgatgcctctggacatctatctcaaggagccctaactgtgaccaatactaaagacatactgcaaaatttggtgtctagagaagagcacaacagttctgaccttgatgatattgttctcaaaatttccactggcaatttgagttttgaggctcccagctctacgactcatcccctaactcacacaagtgagaattgttacaaatttctaggtaaaaccattctgggcagggacaccctaagagaatttatatcatcaccattgtccctgaagacaaaaagatggagtacacccttgttccagacccaggaataacagcaaccatggaagagggaaggatgttcccagatgaaaccatggatcccattgtgatccactctccatcaaaaaataaaaacctgttctacaggaaagccatttcatctgctatttataaaactgatattcaacaaagagcaaaaaaatcttaccattcagagtaaacaatgttggagggaaaattaatgtgacagacatgacacactcacaggacaccaattttcctttggctgagttcattgtcactctgatagtgaacttcccttcattgatgaagatactgaagttttaaatagcagagcttcaatctctcacctataaatgcaatccttactgtggatgatactattcttctcttcactgagggtggttatgaagaaggtaattctagcccacctggagaacacaatgttaggtctacaggattcttagctctacaaattcctggaaaagccatactaattcctaaactatcaatggaaaaccttgaaatatctggcccagtaactaacaaataaccccttgattaattattcaattgcatggtcagagatgcttgagacaatgattgaatatgctaattttattaaaggtagtgatattttcattacaaaccaaatggacttcaagcctcactccttggcctcaactaaatttccaactgcagacaattctacaaacaatgaatttgattcaccatcttctgtaaacagagaaactaccaacattcctaaaactgaaacagatgaaacatattctgaacttcagagaataataaaagccttttctcctacaagaatctctcagcataggatctataaagaaaggaaaataaccaatccctctgatcaagacgatccagctgctaaatttgatataagtcacattacaaatacaacagatctcagtctagctatggagaaaccccttccctcagttactgagcttaatagcctctccacaagtgacaacaatgtgaaaaagaaagtttatatttctgaagcaggtaattttcttccaaacgatgcaagtacattgaaagataattctttccctgttaaatttgatgttacttttgctaaatctgatacatcccaatttaaaaggaatctcttcaattgattccatattaacttttccagaagtatctaggtctaatgatcaaagctcttctcctgaagtcactaccaaagaagggaccattatagacactcccactggaacttatggcctaccatggaaatcaactcttcttccttctaatttcacaacattaacgagttcttctaaggactgtgaatttaatccagttatcaaaatgaaaaaagacaccacaacaactaataacaatattacacctggagaaaggaattcttcatctgacaaattcaaactttcacctgctaccattatttcaacaaaaggtatgaaaaatattatttataatagtagatatggggacaagacatttatagagaaagatatatcaattgaagtagttccttttatagaaaacatttcaaaagagacaaatgacacccctttggcagatggaaatattccaaataatgagaatatgataactattatgcctgttgacagtgcccttgaatatgatgaagataatgatgtctttgcaccagtggagaaaagaagtgttctccttatagaagagaccatagtcactaataattccaatgcacttgagtcccatgaattctatgccggtgctgcagcctctgaaactttttctcaaggaactccaattgatatcagtaccagaaaaaaacaccaaatcttgatcttcaaagaggaaaatcctaacaatgatattactgttctcaaaggttctactgccaattttaacaccaagactccaaggttcatgatttattctctaactgatccaagttggaatttttttgcctgaatttctagatgaaataaatctgaaaaatcatcctctaattggagacaacaccatcgtcattctccctaaaagcaaaaaaatgaagtaccctcttgttttagaactagaactaatgtcaacaatgggagagagcaagatgttcacagctgattccattgatcctgtcatgatcaccattcctacagaatacagggacctgttcaataggaaagatttcacctgctttttataacagtgttgccccaaatgtagcaaaggccaccatatcggccagatttgatccaaataaactgaaaacaaatttggcagatgcactccattcacagagcagcattattcctttgattgaggtcaatgtcattcctgatgacaatctgtccttcatcagtaaagatactaaagaggcaaacaacagagcttcaattatttttacatctatgaatgagccaaccagcactgtggtggattccactgttccttccactgaaggcagttatgtgagtggtgattttatgttacctggagaagataatgttaagtctagaggattccaatctctgctgagaaccaacatgctccttcttgattccttaaatgaaaatccagaaacccctggcctaatgagagataactccttttctgaatcttcaataactaggtcagaagagttagaaagagcaactgaatatgttggtgccattaatggaggcaatgtcccagagaagcaggttataataactcaaaccaacattcattcctatcccttggcttggcaagtttctccaattgaatccacattttcaaataatcccacagatagtgaaattaacttttctttctctgtgaatggaaatactcctggaaattatgaaactgagactgatgaaatatattccaaatctcaaagagcaatagagaaagccttttcccagataaaagagtctcaaaatagtgtctacaagataagaaaaatagctaatctttctgatcaagaagatccagctactatgtttaaattaagtcactttacaaatacaacagttctcattccagctatatggaaaatccctccttcagcaaccaagctcaatcttctctccaacagtgacagtgatgttgatgaagaattccatatgtctgaagcaggaaactcattttcagaagataccagcaaactaaaagatgattctttcactgtgaaatttgatgatacttctttcaaatctcaagcacctcccaatttaaaaggaatctcctcagtttattccacatcaactctttcagaagcatctagacctaatgatcaaagctctgcctttcatattagagtctctaacacaggcaggtccagcacaaacactccagcaagattacatggcctgcaatggagaccaactcttccttctgatttcacaacatccatggatgctcccatatattatgaactcactcctgttaccatcatgggaaaagatatcacaaagaagattgattatagctttctacctgaggaaacaattattccatctgaccaagttatcattttgcctattaccattacctctgaaaactccatggcaagcacttttaaagagaacatatttaagcacaaagattttatagacagtgagcaagctgctgagtatgaaaaaaattattttataaaagacatttcagaaaggatggatgatatttcttcggaaggcaaaatcactccagcatatgtggatgatataattactacgtctgatgacagtggttctgaatatgtctcagataactctgtcttggaattagaggataaagcaaataattcctttataaaaatgagtacactcagatattcccctaagatgcataggtctcaagcactatataccacagtggctgcttcagatagtctctctaaagcaacatcatcagagttcgaagctaaagaaaagtaccaagctataattcctaaatagaaaaacaagaactttgacatcgaggccattcttttcaaagatccctatgccaatgtcaaaaccaaagctcatagacccacaactcacttcctaaccaatgcaagtgagaaggcttctagattttatgacaaaacatctgtcaaaaaaaggcaccataaatggtgatgatgacatcataattccctctgaatgctctgactttggaaataaaataattgagtattccattttttcatacgtgaaacctgtagttgacaacagaaaattcacaactgatactactaatcatgctatcaaaagtagttataacttgttcaggaaaaacatatcacctgccatttataagacatttacacccagtagggcagacactatcacatccagtatacctgattttgctgaagatgaaacaagtgtagctgcagcatctgattgaaggtttagtggttttcctttagcttagctttctagtgatgacatttccaatatggatgaaaacccagctcttactttttctcctttgagaaagatgtcgtccattaaaccaaatgttcctgctatctccactgaggacagaaataacatggcctttctagccttccatcagagagtgtcatgtctctaaaacctacgtctgttggagtacctgaaactctcatcttaactgctaattctcgtactaaagacactgcagctcccagacttgcaaaaagtgaaaacttacatcatcatccaacaatgttaatttcaacagcatcggagcctatgccaacatatttcgcttactttaaggaaggtattatctcaggaaggcaaaacattaaaagtcaaattgttctgaatgctcttccattggtctgtattgttctccaagctgcttccactgactcttcagacaatactggagatgtcaaacctaacacatctgctactcttattaccaggtacaaaatttttgatattgatgcctctgccatttgaaattcagaacctaagaaaacaagcaccaagttttctgcttttgttcctaatgaatatgatgatccgaatttctatcacacaagagaaatagctaaagcttctacagagaaaaacacagctagtgaattttaagtcaatcaccttataaatgtaaatataataacaggaaatgatctagttatccagatggaaacaaactctatacaaaatggcatttttaaagcctgtttctaaggactcttttcctagtcaagtatccctgaaaaatcatagatgtgccaaatgaccttcctggggttttattaagaaatcttcctttattagcagttttcatgttttcacttaaatgtaaggaatatactctggaacacatgtcaatagatataaatttaatactttccttggaaaagacaaaatgtttcaattagtgtaatagatactccaacaatggaagaaattactattcggattaaataaaacttatctatagaatctgattctttgtcctttagtcagataatgtcttcaatgggaatgatcgtttggtcaaaaatgagtatattattatgtattccctggagcacataacttcagtttcatcctcaagagtgctaaaattcctgcagttccaccaggattttcaccatatgctttcttctctttgatggatgacacatagtcaatctgaagtgttcttttgaagggcaatgttttagaaaacatagataatgtgaatagcattccccttagagaaggaataattatgctgcaatcaatgtgatcctacctcacagctatactagtggaagcagagttaatgtgatcacaaaattaatgcctgaaattaaagactatttgacaaattaatatcaatgaagatgatgtaattatttaaactgacatatctaattggagatgaagcgctcataaaagtaaacattttatagcttattccaactctcttcatcataacaaatacctagtcttacaagatatcttccagcaaatatacagctaacctcaccatcttttcttttcctttttgtacacacaaaaaaaaacttcaccaaagtaggtaccaaatcttctgtttacagcatgctttattctgaattaagctttataaaaactaaatgataggggacaaaaatagaggttaagaaaatcctcccactaagtaagcttactgagagaatgactgtccctgtggcattctttactggcccaggaactgatggtatttctgtttagaaacatatttttatagagaattatgatatatctgcaaccaggctaatcgtctaagacagaaagctgaaaactttgaagttgagtccatatttaataaataataactatttgtccttgagatggaacccactattcaggctgatgttgctgccctttctcagatttagttgtgtctgagtatgaaaattcaatttcttctaacaacactggaaaaagactcattctagcattaacactaaactgcaatctgctttcatctaattagctaaaccttaaggttgataacacaaggatgtttgatacaattaacgttattattaaaaatactccctctgaaattgagaatataattcttaaaaataatgcagttatccacatcttgattcttgtttctgggtgaattttgacacatgacaccagctccctgccactgacaaccctccctgtcttctgggttaaaataacagcctgcagaaaaaacattcctaaaacaattttaacctacaaaacttgagactctcactattactcaagtaaattcaagaagaagtaagaaatacaatgaaaaagagaacactaaagacccaaacaggagcagtggttctcccagcacgcagctggagatctgagaacgggcagactgcctcctcaagtgggtccctgacccctgacccccgagcagcctaactgggaggcaccccccagcaggggcacactgacacctcacacggcagtgtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaatattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatgtagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacacaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgagatctaattaaactaaagagcttctgcacagcaaaagaaactaccatcagagtgaacaggcaacctacaacatgggagaaaattttcgcatcctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcatagatgggaattgaacaatgagatcacatggacacaggaaggggaatatcacactctggggactgtggtggggttgggggaggggggagggatagtattgggagatatacctaatgctagatgacacattagtgggtgcagcgcaccagcatggcacatgtatacatatgtaactaacctgcacaatgtgcacatgtaccctaaaacttagagtataataaaaaaaataaaataaaataaaataaaaataaatgaaaaaaaaaaaaacaaaaaacaaaaaaagaaaaaaaaaaaaaaaagacccaaacaggccaataactattagttattatctctactgaaaaagtgggacttcctgttatgaataagggaactaactgaattccctgctacctaattaccttctgtagctatacttactgacaaaaacaccattaatttttttagataccaattttttttaatactatgaatcttaagggaaaatggcttcacctcaaaaatactctgttacttgcttggaagatagacgactttaagctgatgctgataaacttgtggcttccaaagttttccttactaattctaaacccaaaaggtgcctggcagtctctgctatgtctgtttcaagtaaccctagctctatatcaggagacattttccttataaacagaaacatggtaaatcttaagttccctgcaattgaaatgcttggctgtgaatttgatttcataatcagagcggactctatagtcttttcattcaatattcctgcaattagataaccaatcgcagcctagaaacaacctccaaggagacccagtgacattgctcccatagttgatgcaacaatcaccatgatgacccaagctttaatcactctgatgaacactgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccactattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggcaagtattcgactcaataaatgcagatgcttaggactacaggtcatgtaacagatttacggaaacttagaaaaaaaaaccgcagtgtaagggtccccctagtatcacaaagtttcaatattctaacaattacttaatgtaaaatttttcgtcctagccttcagggagtatgaagacagagcaatgtaggggctcatttctacaacatttaatgatgcatatcatttagttaacagtcaatattatacttaagtgagaattaaggatatgaagagaagcaaattaacctctccaaaacattaccatagcctaaaaagttctcccaaaatgcttgttctaagcaattttttcattagtatttcatcagtgattctcttctatttaaaaaatttttaatcctcatataagaattaagacaattcagtaattgtttagcacccacatgtaagatacataagatttatgatagggttcttggcacatgttagatacaaactaaagcaaaatgatattttacaaatatgcatatttgtcagaaaaatgttctgtaaacatatacatcaatttaattttctttctgttaaaatgtgttttctgaatttttgtccatgttttccaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactgatttactgtgtgtaggtgtgtttgatattctactacagacttctcaaattaggagaaataaagagaaatgaaaattcattgtttgtttaaagaataatatagctctaatccccagaagtaaaattattctatagagattcataattgtattacactaaaaaaagaaataagaacaatgccaaaacaccaagtgaatgaaagatattatgtacggggggtttgtatagggatttgcaccattagataaactatagactagaataatcacaacagtgtgttaaaacccagaaacaaattacgaaacaaaaatttgttatacagtgaagtggacttcaaaaacatgggatataatagttaatcttacttgaacaatcagtatttgggaaaaaaatatgttggaataataaacaaatttttaaattctttttaagaccatactttaaaataaattctacatggattaaatactttaatgtaaaaactaaaaccatacaaaaacttaggaggaaatgtacctgtatatctatccaaatggacctgagaaatgtaagcatatatgaaaaggtgataagaagattgataggtttgacaccatgaatagttaaaattctgaaacaaagaaaattaacataaaattaaaaagtaaataactaattttattttacatagcagtgaaaagattactatcatttttctataaaagtttctacaaagtattttaaatgaacagtagaaattaacataattcatgaaacacaaattgttaatgaacatgtgaaaaatattcaatagacatattcaaaaaattaaaataaagctagtacacatcagttttagccatttgaggattgacagtgattattgtacatattcattgttgactcattttccaaactttctccaaatttctccagcctttctggaaggctggaagccaatttggcaatacatgtagcaagcattttaaaaattggaagttttggcccagttattttacatattttacatattttagccctgagaattttcctaagaatcagaaactattaaagttccagcagttattgagctctgactactggtcagcatagttgtgtttatatttagaataacatttgatcctcatgataccctagaaggagaaacattactattctcattttagtgataaggaaacagaaaagctactcaacatgcaccaagcttcaaagttaatatgtagcaaagaacgcttctaacccaggcagtcttcatccagaacccatgctcttttaatcactatactgtaggggccctcagatttaaatacaagaatgttggcaaactcttacactgaagaatgtgattttacatgttcataagggaaaaacactgaaaacaatctacaattgtagtcacatgtaattaattacacttctgtatacccatatgaagccatagcttgcatcttttaaaatggttctaaggaagaatatttaatcaaatggatgatattttcatacaactctaagcaaatttacacagtggtatgtatgcaatatacacatgcacacacatacacacgcaagcagaatgtctggattacatatatcacaatatataatctctaggaaggactgcaggtgattttgtttcattctctgtgctttcgtgcgtttttaaatgctctccaatcatccagaacataaactgtacacaggagaggatgaatgtttgtcaaccccattaactagaaaacctggaagccaagctaaatctttcactcttacttgcttcccatacccaattaaaatattacaagtattttgagtgttccctatgtatcagacactactttatttttcatttacaaggcatgtatatgcactgactatgttccaagcaccatgaaagtgttttgagacactgtagtgaatcaaatgacaccatccctgccttcatggaaattaatctaccataaaagacaaattttagacaatctcaaataatcacacaggaagaaatgactacatgcaaaatatggtgggtgtttcaaagaaaaaacaaaagattataattgcagatttcacatacatttaaggccaagaaattgtctctgagggggtaggatttaagctaaaatattgaaaaatgtggagagataaggaaacaacatctccaaatccttgaggctagatttttcaaggatatgaacagacacggtatcagctggaacataagatgaaactggaaaggtaggaaagagagaaattatacagtacttgttaaacatcctggatcttatctgtttggaagatattaaaggttttaatcattttatcctcaaaacagtcttagtactgagagcactgcctagctgaaaagcatcattattttataaactccaactatacttctttcaagggctttgtttaggaaaataacttgatagtcccctttgcttggaggagatgaggctctgaggcataaaccaaactgcaacagttaaacaattaaaaagataatgtgctgtacaatacaagttaacagaatttggggctagggcttagaaataacaagaagaacagcacactggcaattggttagagtccaggaagatgagtgtccagtgagattcctggtggtcaatgaacatttttccaagaaagcgtgcctaattatgtgttttaccttgcgccatttcaaagcaaagtttctccttgccctgaaatttgattaaacgtctgtaagacacaaggtcttaaatatgcacttcttgaaaaaataaagaaatataggaggcaaagaagaaacagataagtaattagagaatgaatatgagacagtctttcttcccaaatattctaaatagtgatgacctgagaaaggagtgatgggcatacagtgagtagacatttagaatagtcacatttcacagataaccaaagtgaaacagaaaagtcactggccccagataacgatgctagtaagtaacaaagctcagctccagagacttgagtggctccaaaattcaagttcaaatcacactgctttgtgtgaactgttgaataatgaatcattccatctctttatcataacccttccccttgatccattcctgttgccactgctttggttaaggctaatggctgtcttgtagctggtcatctcacctctggtcttgtatttagcaaattaattaagccccacagcactcatctctaaaccgttttgctcactccctgttcccacatgccttgccacagtcatgaagaataagcacatgaaccagtcagagcaaaggggacaagaggaagtgctttggggagactctggggaataagtttctgaaggaaacttctgtctaaagacatttagggccgggagctgctagaatcaccttggatgacaaggagacaggttgcttgacagtaaagtgaacactgaggatattagagacaagaaatataaatatgaaataataaaagaatgtgagactagtcacatcctgtagcaagccaaactagtctgcttatttacctgagacaatgcattttctaattaaacaagtttgggttatgttttttgttgtttgaaaccaacacaccttaaaaactgacaacccaagttatttcaagtccctgtgtctatttatttatttatttggtagagacagggtcttgccctcttgcctggaatggtctcaaactactggcctcaagcaaccctcccaccacagcctccctaagtgctgagattatagtgcctgctgttctcccagtgccacagtctcatgtggtaaatatcgtctttcatattcacctcacatgctatcttctttaaccacccctcggtatgattacctgttgtgtatctcactatatacattctttaatcacactacctataatatttcattgtatttacttgataaaagatcctcctgtgtcacaagataatcctacccatagtttcctctgacacatatatctctgtccaaagttccctctgtcctagtgtaacccctgtttataatccccactgtaccccttccctacagataaccttaccctggggcacagcactatcctccaagtcacagggagcttctgaccacaaaaagagagggagagaagccaatcttaagaggcaaagactcctgaccatgaagaaagaacgttaccctgaggagattcccaaagttaaactagctctacatgaggatgcattaaagaacactcataacttcaaggcaccaagaacagtgggaaattaagccagtgtctttgtagtatatgtgcttccaccaattctacctattgcaaattaggagtaaacaaaggatacatgaattacattttgagtctatggcctttattttcattacagcactactggtgtgttgttttacttttctcacatgtatttcaaacataagagaaggctgaattaaaattggcatttcccttccctcaaatttctcctcttctaatattctccatctcagcaaaaggcactatcttcacagttgtccaagccagaaactggggatcagccttcacttccctctcattctccatacctaataaatacaaagtttttaccgtggcattctaaatacagcagaaatccatttgccctccttgccactgccatttctttatccaaatctctatcaagcaaaagtggaagtttattacacaaatatatcatatcacttccacctcctaattcaaaaaattatccagtgactttccaccaactttaggatgaactccaaaatctttacgatattcatcagagtcaccacaatggaaaccctgcttatctatgcagccttgtaatatgctactatcagtttctgttctgaaatttcaactatatagatctcattttgatcatccttagaacataaagttatgtcttgtatcaggatcaccgaatgtgctatgctctccctgaaaaattctgtaactcaccttttaaagtacacctaaatgtcacttggtcagttatatcctccctggaccctaaatttatataagcccctgtattcttctgtcatatattattcacagtacactataccttgctttatgtagcatccataattatttcaattgcatgttatattacttttttcacactactgtaacaaagtgccgcaaactgggtggttaacaacaagagaaatctatatcccccacagttctggggtatataagttgaaatcaaggtgttagcaggaccatgttctctctgcagtttctaggggatttttttcttgtgtttcttcctagcttctgggaaccaactgctggcaatccttggcattccttggtttgtaaacaggtcattccactctctgcctccttgtcacatgaggttctcctttgtgactccatgtcaagatgtctctctatttataagtacaccagtcattggattaggctcatcctaatccattatgacctcatcttaacttgattacatctgaaaagacaccatttccaaatttggggtctcacaattactgggggttaggacttcagcatattttgcgggggaggacataatttaacccataacctggttaatgcttattttccctcccagactgtatatctgataattaggatgatcacatcatttgttatgaaaaccagaacgtttttgagactgaaagagacaatataataatgactccaaaacaacagctgtaaaccagaatgtcctaatagagctatccacactgtattcaaagcaaagaaaccagacactattgttcagtgctcaattctgagagcttggaacacaatagatgctcaataaacatctgttaaataaatgaataaaatgtaccagtaaatgaggaaatgatgttttcatttattagactgaatgctctcagaagagagatggtctgtactagatgattagaattgaataccagttggccaagacaaaaaggagcttgctggttgcaagctggaaaaggggaaggtcaaaaacacagaagcatgaaggcacttggtgttattaataactatgaagtaagcacaatgggtctgagtataaatcataacaaatagattgtaagtgatattacagctttacaagcaaatcagaaatataatcaaattgtatcagaccatgcatattaggcaggattctccagagaaacagaaccaaatgggatatatagaaagagtgaaaaagccaggctgggaattcaggcaagagttgctatggcagtattgagtctgaaatccacaggggaggccagcaagcagaaaactcagaaagagttctgttacattcttgaggcacaattttttcttttccaggaaacctcagtctttgctcttaaggcctccaactaattaaataaggtctacccccattatgaagggtaatctgttttacttaaagtcaactgattgtaaatgtcacagtaacacctagactagtggttgaccagacaatagggcatcatagcctagcctagttgacacagaaaattaaccaatcacatcttgtgtagcaatttagtattaaaacttcatataactaacagcccatattccctgaactagtttcactgaaattagagtttcagggtaaaatgcattgatgaaatattggaatgaatttcctggagtctttaaataagaatgtatgtaagaagggttcattcagctctatcgtcatggagctctagtaaactcctctaaggataatgttctgtaacatgttttgggaaatgcagatatagacaatgggaggcaaccaaagttttaagcattggatttgcatgttagattgtattttagaaagataatttcggtaaaaacataaaagttggatggggtgatcgaggaagctaaaaacagagatacaaccaactatggcattcatgtaagaaagagaaaataaagcccaaaagaagagcaagaatcagtaagaataattattaacattttaatatttatcaaggtattccaatcacactgttaaacaaaatgatgatgtaataaagcatgagcttaactacacagactcctcgacatgaacattttacgttgaaatctgaaagctctgaccagccctgttaggtatggtaggtgttcctagccaagttttctaagcaagaatcttgtgtattggaatcctgacattttctcttagtctacagaattttacattagaatcatttgcaacaaaggaaaggaaagaaaatttatttttatatatacatatatttacttggtcaaaagcattatatttcacctagattaatgccaggaaatctactaattgatagagccacaaaaatacctaagacagactctctctgtctacaacttattcaccataatgattagccagaatgtctcacaacaaaagttaaacatacataagaatatcttggtgcagaggaaagaaaaagctgtggagaaaaaaaaactggattcaaatattggcttttgaaaatatgagcaagttattaattttctcaaattttggtgtcttcccatacaaaattaccatctatgaaaaagcacacggatctagatctacatcctgatttatactttaggttgttctcattgtttttagtgatcctaaaataatttttagaaagtatgagtaaactgaaaatccaataaccaaagagacgttgcacctagtgccctccaatttacctttgggataaaaagtctagaggtccttctccgttctttcattcatcacagcatgaattaatgccaagaggatataccactgttaacagctaacttgaaagaaaagcattgaaaatctgattatccaccagtaggttttccagatgatgtttttctatctttctggtaacaaacaagggcattttcatggaaattaaagcttgcatcaaagcaaatgtcaaactactacaatgttcacattttgtattggttaataactgtcacatttcttctgagcaaggtttcttctgtgatacaaaactcttgtgtaataaagaattattctgaatctagtggtaaaagatgtatagtaaggggtctcaaaatggttcattagttgcctttttctctttcttttttttttttttttttttttttaagacagggtctaactctgtcatccaggctggagtatagtggcatcatcacagcttactgcagcctcaatgtcccaggctcaggtgatcctcccacctcagcctctgaagtagctgggactacagatgcacatcaccatgtccagataatttttaaaattttttgtagagacagaaaagggtaccatgcccagctaatttttgtagagatggagtttcatcatgttgcccaagttggtctcaaattcctgggctcaagcaatcctcccacctcagctaattcttgcgttttctctagagatgaggttccatcatattgcccaggctagtctcacactcctaggctcaagcgatcctcccactttggcctcccaaaatgctgacattacaggtgtgagggccctttttctcatttttatgttaagaaaatgtgagaaaagagcccattaatgtttcagttgagctaattttataatctctaaaaatttacttcagcaatattttactttaaaaagccaaaaatgaacataaaagaagctatcattttcaaatactttctcccagctcagaatacacattagcatataatagccaagcattatattataaatagcagagtacagttaaaaagaaagaaaacattttaagccttgggtttctggtcaagtttcattaattattgctttgcaataaaatgttaagtaatatctgaaatgaaggaaagagtggattcaatgtatcacatttaaattataatgaataaaccttcactttttctaatacacagataattaaccatgacgttcctgaaaaaaatgaaaaggacaaatgttaacttttaaaaattatacctgtcctttttttgtttcaggaaatgatttggattaacccagaggcaaaggctaaaataataataataatattttgcttcacaatatagaagggataaaggagagaaaaaataaccctttataaggcacgaatcacctgtgctctttcactgagcttccagatttcacaagctgaggaaaggctgacatttctggacaaacaaaaagaagaccccctcgttacagtatcttttttttttaatttcaaaggcttaaaaatccattttctttagtctttgattatatgcagtttctaattagtggaagtattatgaaatctcagactgctttccacataattccaacagaaaaaaatgcatttgaaaggaaatactgtaaacagaaaaaaaatgatactgatttaataagttctcagcctacaagttttatccatttttaacagtaaaatggtaagaatttcaggaaaaatgataatgataaaaatagcctgtcctccagaatctcagaatctttaaaatggccctttctagacataatgccatattttagttttgaacctataaaaatgaaaatgttctcagtggcagaaaaatcaatgtactaaatgatgcaggaaatcattgggcctgattttatattagttgattgcctctattttatttatctcttttgttacaaagggacctacatattaattttgaaatgtgtctcatattttgcttgagattatgactgtttcatatggaagcaatacacttgttaatttggttttctattcttatttttggggtattgaaatctgaccacttcatcaatcaaaaaataaatcaccttattttaaaaattagaaaaataggcctctgatagtttaggtaatatgaccaggatttggcaactaaagctcttagctacttttctttgggaaaaaaatgaatgttagcaaaaaagaaaaaagagagagagagattcattattgaagtatcatgtgattgcaaaattatgaagaaagaatatttttataatagtcttcaaataattaccatttgagatggatttgttttttacattttgtttggatgagagaattcagaagtaatgattgtatcaaaaaaatgaaagtttaacagaaatactaaattttaagagttatttgttgataataaaattaatgctgatggtaaaattaaatgagtatttcatatttctaacaatatatgtattttaggttatgagttaacattaaatttttctgtccagtgttttaagtatgtaaggtgaaaattagagtcagaagatcattttagtggaaatttcttaggttttttgtgtgtttaaattatgatatcaatagaataccataaatttttttgagaacagaaaatccacacataaattacacaatcatctcatatctaacttcatttatgcttacatttttctgtcatctatgtggataatttacatatagcatgatatttaaacatttaccttattacaacataagcatttttcaaatttccacaaacttgtatgattatgagtattgatgattatgagcattcatatttttaattatgattatgagtattcatatttttatgattatgagtattcatatttttaattatcagtaacactgaaatgaacacaattgggtttgttctattgcttaattagttgaggatgatttccataaattaggttttgaagttacaggtatcaacattttcatgtttattttgtgtattgttatacggctattaaaaaaattagctaaattaatagaactaatggttgtgtaaaaggtcatataccttaccacattctcaatcttattttgggtttgccttcttaaataactgtttagtaatcataaaataatagataaaaaggtaggctcaatatttgttttcctgacaattaaatgagaaattttgtcaggattcttcatttactttatgtagtgttattagaattcactattcttaacctttgctcctatatgttgaactccatgtttttcttttaaattgtatgttcttcttatgccatagatatgatatatgccatagatatgccataatagacataagtgtttttccattggttaaaatttaccaaaaacaaatttttatttctttttttgtctcatcaccaatgaagctgcttggttccagaggacccaaagacaagatgaaggctctgattttgtttgcaatcattttggtctttactgcttacctcacagttatataaaatattttacatatatttattttcttattcagttcctaatcataaggggtacattcagttcattgttttatgccaatgtagctttatactaaatgtaccctgtttttattttatgtctaataccttaatttaaattcctctatgatcttttgttgaccttagaatgcaatcttaatatttttcttttcccacatactgataggtctttagaattccaaacacatgtaaattggacattgtagtgttgtgatttttaagtttttaaggtactctgattctacctctgcaggagcactcctaaataaaatttagttcttggtggactctccagaaagaaaaatctgggaagaagaaaactgatcataagaaacactatcaaatgaatatgcaaccacataaagaattccacacggatcaaataaattaagaaaatctagacatggtattaacttccaagcaagagcacgtgcttgctatcccataatgtttttagatttgttaacctaacacctgcacctaaataacattatctagaggatgagagggacattgtctaagacttactgctgcgaacataatccagtatcatttcatgaacaaacagtgtcttatgggcactgctaattatgggaactgcctcttcttctccttccccatgctaaaatgcagccaggatgatttcccatcccatgaaaaaccctattccagaacttctttggaccactcatttttctcttccataaaagacaggttggttttttttcttacaccaactccataaagatgcttgtagtagtagcatagtggtctccaggctggacacctgagtgaatggtagttataatgataaaggaagccaaatctagcagtacttggccactggagaccaggtgccaacacactcatgtgaatgtggaggaaaaggaatccttctgctaaaaggattcaagaaaaatacatcatccttattccacagactgtgcaccctttaaactgttagaatgttgctcatgcaatgatgacaccagaaattctaaaactgtatttcattctattcatcctaaggcaaacatattttgccctcatacctgacttacaatcactactcttctcaaaatgtcatatgtgctctggatctaattttttaatgtttgtgttttccatctcattttagtctgttgatgcgcataagaaaacacaaagtaagttttattacatttctggttatgtttttatattttcaatcataatcaaaacccattatgtctgacaagttgataatgtacaaatattttatttccaaccaaagaaaatgttaagagacagagcctgaatatcaaagtttaggaaacaaatgggaatagctgtgtaagcaccaaaatcttgcctcagttacctgcctcttgatatgtattaatctgcaatgggagtaggaaaacttagttcatgaaatgcaatgctttcctagctatcagttccaaaattaatatttctttgttcaatgtagatatattttccttatacatgttgatggttgatggttttttagataaggcacattttctatgatcctgcaaaaaagcgaaaactctttattttcttaaactcagtggtgtccagtaaaaaaggggagaaaatccaaaatcatctggaaagacttttcaaaattccaaatccctgcgtccaccctctgccatttctaattgtcataaccccaccccacgtcagactggaggtggaatgcacagaaggatgtgttacctgaaaatacttgtcataacatcctgttagatccctcttctcctttttccccacaaccagacatgtactctaaaggaagccttaaaaccaaaaaaaaaaaacaaaaaaagttatcctgcctctaatcctgtggaatatacatttctaagtttaacgacccaaattgttctaatattcagaagaaaaaaaaaaacattccaaacctgccttgaaaatttcagcaatgtacttcttctccattctctttttttctccaccccttcagcttcatcaccttataattctcaatgtgaaataattctgagaaatggccagatacctgtaacaggattggtctgacaacctccattcagtgaaacctagaccaatctgtgaatattcaatttgtctcaaacactgatcattccatagtatccctgaaatcagctactcacatctacctaactgttggagttgtaagtagggaagacagaagctgcagagtaggatatttttctcactcactgatcactgatttatattattatatcacgtttccttttgattgcctaaaggtaaatgtagccacatataccaaggcatcaatttgggaaatatacatgagatctcacatctacagagcaataaaaatcttgaaaagggtcaagagaagagaaaacaacattgttagaatgttaaagcaggcttctagttaaattaatttatcctaaaggttgagtggctcctgggtcttccagtaaagatctacgggagtatgagatctattcagtgaacagacaacactgtcagagtcacatggcatgggagcaccagagcccgaggaatgagtcttcccccagtagtccacactatcagacactccaaattcagtctaaaagatattggcattaggaatatgtacaacacaaaaatagatgagaactaatgcttcatagagaggaaggtgaagcatcatatttgaacttcaagaattagcctctgccagtgaagacgaaatgagagaactgagtctaatcagaaatgctcagggaatgtcatgtcaaaagtctgtaactgaaacgaattaaatcaaagtgtcctttgtgttatttaattaagactttcacagggtagaaatgcactgactcaaggtaattcccgcttttagtgtctgtgattctgtgcaatgagtcagccacatagattcatggaatgttttatcaatctcattgtattttcagctctatgaaaggggacaatgaaaagtttatctttattcagagcagtaaaatgcattatacttttttacaggatggaaattagaacagatttctcaacaagtgctccacaaaacactaaaacactagtatgaagaaatgctacaaacacacacacaaaatttccatgattaagtaaaattgagaaatatcgatatcccttggatattctaaatatccactatatattatgttaacaattgcaataagtcctacagtaaagaaacatgttttactttacccaaaacctttccaaagttatttggtcaccaaaattttcacaacataatgcgtattatggaacgtattttggaaaaacctgtaataaaactatcaaactttgagcacagtagggacacagtttacttcatttatatctcacccaaaatcataattaaaaatgctgtatgagatgggtatattattctatcaacttacttatgaaatgaatttagaataattgtataaatgtaaatggtaatataaatacatatttaaagcttgactttagtttatgcatcccatctgtgtaaaaacaattatttgcttgttttgtgttctctctctgaagtctagccatagttctgaaaagaattttaaaccactgaaacaaagtcctggaaagccaaactacaagcagtttataaaatttgaaacagttcctgtggttccccttggtctccatcatctcttccaccatcaaagccctcatcaccccaaccacccacattgtccatcatctggacctacacaaccacctgagaatgatgtaaaccctagttctcaagcactgctagccacctctgctcctgcaactgttgtggccaccacggccactcccattgcctctaccagcaaaactacaggtgccatttccaacaccacagctcccagcaggctccaatctgaggctgtcacaaacactgcggcaactgagtctaacccagctgaggtggctgacactgcccttgccaaccagcaacaatagttttagtacattctgcaactgtctgagactacaataccaaatcatgagaagataaaagcaaaccaagaaaatgttttccaaaatattttctgagtaactttgaggtgtgtctggccacaatcaaagagaaagataaacaaatagttcctaactctggcatatgaattagaagctcttattccccctctatttcacaaactacatttggtctccttaagtataagtcatatctataaacctgatgctggctgattcccacaaaagaaacacacaactaaaggatcaccaaatgtgcacaagattttgcttttttatcccagttctaaaatatgttttattttcctggaaaagcttacttttaattagggttttcataaattaaagttagtttggacttcaatatttattaaatttcacatagtgcacattccacataggaagtcttcctcactctttcagcatccgccaacaataataagacaaaaaaggagtaaagattgtaggaaatattataattatccttgggaatagtaatataaacaaaacccaaccaatacaagagctctcttgctataaacaatgactgaatcacacacatcatgatataacatgatcattcagaaacaatatcaaagaagtaggagatcatatattcatcttatttttgaatatagcagcttctaattataaatataaatgggaagaattatcctaactatagaatgtaaaaatcacaatgatagatgccaactgttgaacacttagttcagatgttggagcattaaatattcctattgaatttaatttttttgttttttttgagaaagagtctcactttgtcacccaggctggagtgcagtggtgtgatctcagcccactgcaacctccgcctcccaggttcaagcaattctcctgcctcagcctcccaagtagctgagactgcaggaacgtgccaccacacctggctaattttttgtgtttttggtagagacggggtttcaccatgttagccaggatgatctcgatctcctgacctcatgtctgcccaccttggcctcctaaagtgctgggattacaggcatgagccacagcgcctggccttgaatctaatttaatactcatatcaaccctgtgaaaccagtcttgtggacttctttttaaagatgagggtactgaggctatgagaatttatgtgactttccaaagaccacaaagtcataaatggtagaccagtcttcaaattcacatccatttaactctaaagttgcagcttctaatgtcctacgcagcatttggctattttaaaacaattcgagagggtagagtttatgtacctttagttaatggctcatgatattttgttctgtttttacagatcctgaaaaactgaatattgatatatttgtgatcaccttctctcagcattttgttttaacaaaaatataggaagaggtataaaaatacagagatatgattatttctgttttttctttcatcttgctacaccataaaatctttcaaagataaacctgatttatgcatttgattatatgtgtattgatctcttctttattcctgtagaatgacagtgctaataccagcacatttatcctatcaaatgtttctgtaacacacaaagtaggtgtcaaaaaaaagtaaactcttcacagactaaaaaaaaaggtgtttaaaaaccaccccatataatgttaatatattacaaatcttacaaatcaattttctttttgatataaaacataagtacatgtagtcataataaaacacatctataaacatacaattatattttacataaatgcacaatataaaattacacatatgagagctacaaaaaaaggtgaagaaatggcagtcctactctcaaagggatcatagtctaagtgagacattttcaaaaagcacagaaaaaagtaagttaaattcccacagatctacagatattctttcccaattgctacttcatccactaaagaagtattttcaccagagattgtttaaccaaaatgttgtaccatctcatatatcatttcatccagtgatatattaatattaggtcaatatctagttgataaattcacccccgtgatttagtaaaacttacctagatttaggacagggaatataagagtacaaatacaagagcattattcctcacaacacaagttctcctggatattgatgggtatgaaaaaagaggagaggaataagaaggaagaagagaaaagtagaatcatgtgagaaacctgaaggaaaaagagcaaacagcagattaaaaagggagcattcagaggtgagagaactaagaaacttacatgaaagccaagcagagaaaaaggtttcagaaagagggttaaacactttagaagagagagtaagaaggaaaataaaaatagaagtataaagagcaaatgcttggaaatggcaaatgtttggaaataagagtttcatctgttgccatttctctcttcagattttcctataagtcctgtttttgctattcacccatacttctttgtctcctatcccaggttcagtgttaattaggtacatctcaatttccatttcattgccttgactcacacatctttatcattctgaaagagccttccaattatctccacttaccctacttgactcaattaccaacttcttactgaaatcttacatgactcatggatatcagcttgacattgctctgtccttcagtcttcatatctagaccatcaaaaggatctgttgattatgtcccatgaaaatatctttattctgtccacttatccatccatagcccctttgccactacgcaagtctatctggacaactgtagtaacagccttttaacaggtttttctctcttaagtttcacttgctaagatccactctccatactgctctagggctcagagtcgtcaaaataaaaaatactcttcagagaactctatctgaataagtgaattaggtactgaaataagaagtgatttcctcatctagactagtggtttttggctagggatgattctgtcccccaggggacatttggtaatgtttggaacatttctggtcatcacagctgggaagatgcaatggacacctagtgagtagaggccagaaaggcacaaaacagatacccacaacaaagaattacttgacccaaagtatcgatagtgccaaggctgagaaaccctgctccagactatactcaactttgtattcttcaaaaataagtgttaaggcattgagaacatcaagtgtgatagatttactgaattatggcccaacttttcacacttccctttaagaaagtccattgattcccaaatgtccatcaatgatagactgaattaagaaaatgtggcacatatataccatggaatactatgcagccataaaaaaggatgagttcatgtcctttgcagggacatggatgaagctggaaaccatcattctcagcaaactaccacaaggacagaaaaccaaacaccgcatgttctcactcataggtgggaattgaagaatgagaacacttggacacagggtggggaacatcacacactggggcctgtcagggggtgggtggctgggggagggatagcattaggagaaatacctaatgtaaatgatgagatgatgggtgcagaaaaccaacatggcacatgtatacctacgtatcaaacttgcatgttgtgtacatgtaccctgggacttaaagtataataataaaaaaagaaagtccattggttgtatcctcttgcactgtctctgggcctgacaattggtaatttttttttttttaccagaggacaacactacactaatcaaacttgaaaaaagcagaggtttgaaaaaacatttgcacatttctgttttttttcttttgaacccctcacatcaccatgaaaacatgcccagactagcttgaggaaagtaaaagacatgtggaagacaggtgagctgtcccagccaaggtcatcctagaccaatcagcccccagccaattcaccagctgaacacagcacataagtaaggccagataaaaatcagtcaggcctggctaatccaggaaacctgcccagtgatcacactagtatttttagtaagaaatactcaacaattgccgtgttaagtcatcaagttttgcagtggtttgtcatgcagaaatagctaactgatacactgagagatcccaaaatcaatctatatctcagggtcccattatttaccaatcaagatcctaaaatgggcattgcagatctgcctagattgagcataaatcttttccagaaatttgctgttcttgtgactgagtcctagttctgctcttcagatgcttctgccttcacctataggaaagcatagtttatacccatgctctgaggaagatttcttggccttcacatctatcctttaatagcctttatttatcttcttccgaaagcaacaattgctccccaaaacagcttccagttaaaacgaaagaaatatttttcttgtctattttcctcctttcaattggattctattggaatgtttctcaaagaatactttatgaaacatctgcactgaaagtatttatggtgcctactaacactgcaatttcctgggccctaacctaaaccaaaataatcagaacctcagccaatggatctttgaatttttagttatcaccaacctccaggtggttattaagcacattaagacttagcacaaatatgtgagatcttgaagaggcccaataagagattaatgacaatgaaactgaggcatcaggacttctttgctgaggttcttctaaggtaaggccccctgaacagatacagcaacgtgttcaaaaagtcatgtgtttttataaaatttgaaaaagcaggatattttaactgccattggctaacattgctttttcttaattttccgatttttccacgagcacacctcccctcatatcaggtggactttggatagctctgaccattttgtattcatgatttctcttataaggtggccttgcagtggttgtaggaattttctaatcataaagctgtattgttttccttgtagtcagtgcccaaattatataagcttcaggtctctctaaacctagatctgcttgtaatggggatgccagggagctattcaatttaactttgtcattttacaaaggaagaaaataaagctccaagagattaatgaacatttccaatgccatgctagtaacagatggcaaagtcaaacagtaacaatacactgtttcctcctaaatataaagctgttatttaaggcatttgtactaacttttaggtaatccctcattatttttaatagacttcatttttagagtcctttatcatttttaagtaataaattcataccagtagactgtatataattttaggaataactttattaaacaagccagacatgatcttactactaattctgcccctctccgatgttctttcttcatttaaataactaagacattaacatcttgcagttagtttgtatattaaatgacaaaataaatataccatggttcaccatataataaatgtattacactaatggtttaaaaaattttaagtacttgatgtaatttacagagaaaacttgtatatgactagatttgtttttgtaaaaataatattatggcaaagaaaatatatttttagaattgagatgaatccaggaatattccccaaaagagattttgaaaggggaactgaatttatgtggttacatggatgaggctatcaatctagcaaaattctgattaaagggcaattgaatacttgtttacattcacaaactggtgacatccaggttatactataaagaccactttcacatttactatagaaaaatacacctcctgcttaaaaacattaggaaatttcccccatggctctcagtggaaaaaaaaaaaaagctacttttcttgagaaattatcatgattatattttatggacattgtaaatgtttcatctgatttcttctttttataactttggctacttggaagctcaaggcaaatttgttgccaactttcagaaagtttacagacctatgtgatgtgggtttcttgcagtatccatactgcacaagtcagaaaataacttttcttcagtctaaaagcgctattgttaattacatttcatcatgttagacttcaatccaaaagaatacatattctctcagagttcagtggcattattgatatcctacacaacaatatttccacagaaatttttaaggtaatctgtaaactctaaagcttgataaatattcaaggtggcattaccccagaaaccatatcacctccttctgaataatctagaagaagtacatactttccataggtccaaagaaactatcattattgttctattttaggggaaatgagtgtaatacaataggaaagcagacttcaaatatgttgctgcatgactcaacttaaatctgctagtctacctatattagggaaatattttccatctgtcacataaatctctgcactaacaataatttttctttaccgtcactttgaattttctgggaccagagacattagctcctttaggtattgttctagtaagtactcagtcaagatcttttaaagccatataagttaattaaagattaactggagtaactgttcctttttcttaacagacgtgtgcttccatttgtttgtgttcctcaaattctttgttggtcacaacccactcagaaattgtccgttggttttgccagcgttcatcctaagtccctcagagccagtgatccattacaatgtagatcacacctcgacttcaaacatttggctgatgaatatgttggcatcaaaacaagaaagaagagacattcatcttttgacacactgaattactgtcaaagaaagaagtgaaaatttctatgttaattaggaatagaaccattttcactgacgtttgggcatgtaatcattcagcaacatattaagggctaagattagcaaaccaggaatatattgtattacacttaattatgtcatcagaatttttaaaggcagtgaaactccaacaaagtaaatgaaattaagtacagtcattcaaaactaacatcaactctgaaagtgtgacttcttaatttctacatcacctatgactcacaaaaattttaaaacactaatcatttagatatgctgtaacttcagcaacttgcactctgtcttacacccacaggtagctaataaatgttagtaggaaagataaaaggaaaagggaaggaaggaaggaaggaagggagggagagagggagggagggaaaggaaagacggagggaaaggaaggaaggaaagaaggaaggtcctaatctccatgacttagaaattataaatataaacattttaaatatatatttttaaatgaagaaattgagacacaataaggcaaaatatcttgtctcatataacccaacaaggaagtattgttactgtgctttgaagtggaatgaactattaagttcacttgattcatctctctgatgtactgtaacacaatgttagtaaagtgtatggtgattgttaagattagggaggtaatatggaatactggttaaaaaaatcacttaggccttgaagtgggctgacttaaggtcaagttccgctcagctaattagcatctctgtataaaactgagatgataatagaactcattttaacctgccacatggaatatgctagaggctcaataaataatagctgttattatgattatataataatgtattaaaacgagagtataagatcatccagcataggaaaaattatcctcagtgcctagatttatcaaaaagacaaggctataaatttccattagacatccacttcaaagtaaaaatatctgtataattttcccataatcaaatctttgcatgtcatcatattttcatttaattaaaactctcaagttaataacaacagggaccacatgatttttaaaacacggttgttctcagttcttcactgacaaaagggaacttcctatagaaaatacaaaagatggcccattaaataaaatagaaaatacaaaagatggcccattaaaattactcgggatagaaaaagttggtgctttttctttaaaataaagaggaaatggtgcgccacaggccccagattgtttccctgaagtgagaggatattatttgttgaatctgtttccccaggaaacaacaaatattgaacaggtcaatgcttttcagaaatgagacccaaaaaatgcggaaaaagactgccaaattggcaagaacaactttcctatctttgtttgaagagcatcagcccagaagttattttatttccaagtagcctttcttttactgccaacagaaatcttttgcaatatataagaactgaagtttcttgtctcttttcacctttattttctgtctttcaactggcaagagtcattttgaccagcaggttaatcaactctaagacagatcctcacgcaaaggtatgtacctggaaatattaactgaagaaattttttctcagacttttcatgagctttttataggacattcattatcaccaaaaacataagcaccttcaccttatgtaaaattgtaagtcgttaaacatatcaaatcttgaaaaattatgttattcacatgtcagagtaaagcattcatgttgggcattgaggacaattagtccacccaagtacacaattgacttttccccttgatgttccttaaagttcttgaaacttcataatgatagattattctcagatgtactctaaaagagggaattgttccacagtatatgtttattattagtttttcttttgtttttcaaacttcttataagaacggatcctgggaaaagtaatccttaagggaatagccacacccacatacaattgaatatccagtgaaattttgtccatatgattctttcaaaacttgcgttgttcagacaacacactcaacctatgtgcagagttgactgtcaggaagccatttgtacaatggtgcatggagttgctttcccagaactcaagctatcaggtacttgaaatatttcacaaattgtgagccaactgtgaataaaatatctggactcctccatattctctgacttggtctttgatctaccatatacggatttttggaagcactttgagaccacacatcacagactaaattaatttagtggaatgttgttaaaactaggagatatataatatgactctttttttcttacactacatcaaacagagtgatttctttcttttccttatttttgagatatcccaaggaattacactaacatatgatctagttaatatgttaatatttcaaacccaagcctatagaaatctataaaacaatgtacctgctatttaaaaatgcaaaagtattcaaatgtaaataattgtacatgtcaaagtagttacctctaaaggcaaaaactgtagttacaaaagcttctattgttcaatcatttatgaacaactctttggcattatctccagtatcagtttacaagtcaaaaataaaaactacttccactattttgaagtcaaattttataagcctactaatgttgtcccacagtaatactgaatccaaaataatgttaggcaaatttcctaaaaaggctacagtagtatatctgtactacattatatccatgtgttgagacattttaaatagtactttttaataaaaaacaatcatactgatcacctattgtgcttactttcagaggcaactgaaaggatgaaatcactgacttggatcttgggcctttgggctcttgcagcgtgtttcacagtaagtatcattaatcacgatcacacatctttatactttctcattaaccattacttcagatttctttttacattaatgatgttaccttttcttatatattagtaactattaaccgttgatgaaacactgttctagtggttaaatttaaatttaaaatctaatttaatttaaatagccccatatgtctgatggctacaatactggacagctcaagtctgtaatatcagactgcattaaacagataagtataaatgtaggtccccatactctagcaattacacaataggtaaaactctataaaatgagatagtttaaagtagttgttcctaacatatggagtcacctaactcacttattaaaaatatagtattaaagtcctcatccaagcctgaataataggacctgggaagatgcattttgcagaggatttaggagaatctttgcatgctaaattttgaggaaataataaacatttatagtaacacctaccatatattaaaaactaggttaaggacaactacccttattgtccttaacctagtgtttcagaattttttaatgcatatttttaaaagtaatagaatgatactcaatttcaacagaagggtcaattaattccagtgttacaaagaggagattaattccagagtaacttctcccaaagtaccataaaatctattatatcaaatgggaaaatatgaaagctgattttttagaagactatgacttccacaaagcaggcaacataaaattatatcattctgaaacatgaaacataaaataatacctctttcttctacttttaaaaacttgaataaaaacaggacattctgagatgactgaagtattctgactttggccaccttcctgcatgcattatgggtggacataatttttgataagccaataaaacatattgacatccgttaaatgtcatgtcttaatgacttcatcataaagctgattttcaacattttcacatcctcaaaatacaagagaaaaacattttattcaggcttttattatacaaatagtaactttttacaagataaattagaaaaacagagctttccaataatataagcagtttaaatagaaatgagcctttttccagttgatatgataatgatgattaataattactgaacattggaaatgtgaagggtagcatgtcctttgcatatacatatttgtagatggggtaagtcatcatattcagcctgttaccttttgagtgttttctctgttataggtaattttccaaatgcattacatacattatctcttctttaatcctcaaagcaagtctcactatttttaatctcactaaaatacaaataaatttagattcaaattatgcatgtcttagctggattattgctaaattgaataatgtaggagattaacattaattatagccctttgagaggggagtgtttcttcctaatatagtattttcatcattttcatcattttactttagccagttgtggaaagggagcttatcactgcgattgggttaagagaacaggaaaagaatagatatttactatgaagatttttcattacataatatttagatcaacatcggtatatctttaggaaaaggtactttcagctaattttttaattgtctcaacaataaaaatgtgtgaaatatttttccatactaaggatttgttttcttgacaataaaaaatcaaatcctgaacttccacataacctgactagtccttggattggcagcccttgggtcaaacaccctgcataacaacttgaaccatcactagctagagaagacaaatgcaaggctggtcccacagaagtgccttggaattttttgtttgtttcattggtgatatgaataaaacttttaccggcatgttaagggcaaaagccaggttgaagagcaaatgggaagtgagaagtggggttggcaaatttagaatactctttcatagagctttgctttgcaggaaagaggtgaaaaggaggtcacaacaacaagggtattggtggttgaaactgaatcttttataaacagggaaatatcaatttatatttatttcccaaatgatgtcttcgacctctctgtacgtgttaggtgaaagcggcaagattagaatcaagaggtcaaatcaacgggccctacagtaatttgggtaaaagtaaatgacagatgagaatgaaagcaagaaagatgataagaagtggttagatttagaattcagggagtgggatgaagagctgataggatagggagaaaaaaaattgagttgaacataaatgatagtgtttttctgaagaaaatgagctaattaaatggcagatattacttgcagaaagtaaaagagaagactgacagagccaggtccctcagaaaacaattataaagaaaaagaaactgtctagctatcaatgactccatggttgtgtggccagtaaatcagggaagttcgtttctaattgcctgaaatatcttggtgaagcaggagaaaagccagtttggtgggggtagatgagagctcaggatgaagtggagaatgtttataaaattggcatcaacttggaaaattacaggcctctggggaagtgggaagagataatctaaggtaagatactcaaaaaaggatttcaggcagcactgaaggacgctaactttctgatggtacagtgcttgtgacatcctctagcattgttaagaacctggaactaggaatccaggagaaagatggtttaccgtaatactaaagtttaggattagcaagggtaatggccagacaaataggtgaagggactgagaaccacaagaagtgaatgtagttttgtgccctatataaaccatctgctccaagcaacctggagttcttgccgtcagtagagtggaacttcattcttaccccagagcatttgcatattttccttctatttggcatgctccctccttattttgtattctttaagcctcttttcaataactccttatcacagagacaatcctttatcattttcctatccagaactgatctctttaaatccctaatgtatttgttccttgcactacttttcagctatttttagatttttaatggagatggggtcttattatgttgtccaggttggtcttgaactgctggcctaaagctatctacctacctcagcctcccaaagtgctgggattacaggcatgagccaccatatccagcctcagctattttcatttctaaaaattgtactctatgtaaaccagacctgagataagcaccaccctaggcactttacaggtgatatttcacaatagatgtgacaacaaccgcaggagatgggtacttttatgaacatcattttcctgataagaaaaagagactcaaaaaggattctatactcaccctatctctatgtgccagaaggagagctcaaacactggcatgaaatcccagacactcattccattcatttcacttccctttagatcacatttatccccccctgtattgtaattactcagcctgtggattcatagaagacatgtttgtacccctggcaaactgccaggttgacattcatgacatgaatgaaccagctccttcattagctcattgcacaaaatagttgctcacatgtgtttcacaattaattaatgttcaaagcccagaacaaccctgaactcttgaattagacataaaaagacgtgtctttcccatgctgcaaaggcatttatttccatttagaatttggaatgacagacttcactacaggccaaggataagatttttgctcattatctattttttccagtcaatactatccaagctttcattgagagcctaggtattcagagggcaaaagagaaacatttttctttgatacagaagttcatacatcataacttagatacatttaacaattttctattgctcaataacaaattaccactaattagtagcctttaaaaactcattattatctcagtttctttggccataactctgagcttggcttaggtggcttctctgctcagagtctcacaggctgaaaaggtgtgtccattgctgtattttttttttctgcacctcagtgtccttttttaagcttgcatggttgttggcaggattcagtcccttggttgttggactgaagcccctattttttttgctgcctatgagccaggggccactctcagctcctatagccagtctaccatgtacttccacatggccctcgccacaacacggcatcttgattcaaagcccagaggaaagcatttgctgcagcttcaaatctctctgattccttctcacattgtagaacctgttttaaaagggctcacctgataaggtcaggccagcatgtgccagcagggagtagaaatcttgaggccatctcagagttctgcttaccatagaaaccattcacccttatatttaactgtgaaatatctgatttaaaattatttacttctttgtttccacagcctggtgagagtcaaagaggccccaggggaccatatccacctggaccactggctcctcctcctccaccatgttttccttttggaacaggatttgttccaccaccccatcctccaccctatggtccagggagatttccaccacccctttctccaccctatggtccagggagaatcccaccatcccctcctccaccctatggtccagggagaattcaatcacactctcttcctcctccttatggcccaggttatccacagccaccttcccaaccaagaccctatccacctggacctccatttttccctgtaaattctccaactgatcctgccctccctactcctgcaccctaaatacagacaactgcaacaggtgccaccacccacaaaagacaacactaccctcgtaactactgcttctactacccaaaaataagaatttcaacactacttccaagagacttttagataaaatcacttccatttttggatgagaataaagatttccaaagcactgagcttttgggagaaatatcttagaaattgtgaaacgatccccatgaacctttatatcagtaggggaaaataaagaattgagcaacaatatgaagtatccactgttatcagagccaatagtttacaccccagttatgtcacctaaatgaatattagtgctaacagagcctggccttgtcccatgaagccaaaaaagtaaattaaggaaaaatgcaatgagacacttggacttgaaccttagagttacaaagttagaagagtaggcaacaagatgccctcttcagtatggcaacccatcatacaattacaaagcccaaaataagtgttaatagatactaaaatgaaagaatcttagcccttaccatagcttgccccataaaaattcctgagtaccatctgatcactgcttataaatagttgcagagaagaaacaccattctaacaaacctaaatatctgagatgtgaatcacaagtcttagagtttgatatgaaaaaatcattttctaagctaagatagagataggaaatggtttcagatagcaataagaagaagctgatggctgagatttccaagtttctactgcatctatttgttgatgtttgaatcagaagtattatgatacgactatttaggaaatggcctcatgatgtcatgagagctttatctttccattccatgtttgacttttttcttcaggacacttaactttccacattgccatcaaacacttataaattaaaacttcttaagacacctaaagtaagcacacaatttttatttgtgtttaatgctctccttttttttttctttccatggaaagggtctcactcccatcacctaggctgaagtacaatgacgcaatcacaactcactgtagccatgaattcctgagctcaggaaattccacctcagcttcctaactgggattacaggtgcatgccaccactcctggctaattctgttgtatttttagcagagatggggttttgctatgttgcctaggcttctctttcacttttgagaacctaccaggatacagggactgttttagtagcaaaataacagcaatattgaaggtagtcaaagtaactgtcttcatggagcttatatctagtgagatattttttaaaaagtaaacacatgtcaataaaatgtaagatgtgagagtgttttgaaaagtaatgaacaatgcatagggagacactaagtagtggtgactggctgttttatataagataataatggagaagctctctgatgaagtgatatttgaggaatgacttgaagaatattaagaagcaaggtactaaatgatctagagaaaaagcaaccatgtaaagatctgaagcagcaataaattttgtgtatgagaagagtcaacaaaagttaatgtggttcacactcagaaaagaggagagtggaaggagatgatatgaagaaggcagagaaaaacacatcataaagggatttagattttgaactttattctacatgttatgggaagtcattgtagctttaaatgaagaaataatattatgtgattaacattttcaaaacttcatcactctggctgctctatggatagaaaacttagaagagcaagagtgcttaatacctaggtgataggttgatagatgcagcaaacaacatggcacacatttacttatgtaacaaacctgcacatccttcacatgtatcctggaacttcaaataaaataaaaagagcaagagtggtggctatttcaggagtcctgatgagagaagaggtggtttagactacggaaagatcagcagagatgaagcgaagtggtcagccacaatatacagttgaaaaaatatccagaaatctttgatgaagtacggaatcttgggttctaggaaaaatacgtaatctagaagcaactctgataattttggcctaaacaactgtgtcaataatggtgtcatttagtaagttaaaaaatgggaaaagatcagggtgtaagggcttggaatatcataaattctgcattggccatgttaaggttgagttatccgtttaacttctgcattattgtattgctgtcataacatgttatcaccaaattaaaagcacaaaataacaaattatctcactaatctatagaaagaattttgttaatagtatagctcaaatagttcctctgcttagagtctggcaaggctacaatcaaggtattaatagggctgcatgcctttttgcagactccagggaaaaatctgctttgaggctcttttatctctcctatatatctcttcttcctgactcttgtttggctgcatctctctgaatctagccagaaaaaaaaaattcacctgtttttaagataaatttcctttccttgattatttaataaaagatagactagagtagatatgaagtttattgctttgttgtaaaaattgggggcaattcaattgctggtaatgacaatgtctaagggattactgtgaaaaaggttgggataaaatacaacaatgctggcttttcaaatccaaatgttggaagtaagcaggtcaaggaattaggaggccatgggttggatgaatcatttatagggatgttgaagtcaccaaatgtgacaaataaagggagaagacagtgaccaaagtggtagtcttttaaaaatgtcaagtagtgatcgggcaggaagaaataacttcaatacagaagagtagtggggaggcatagcttttttgaaggttcttcaaagttggaatgatggaaaagagatgaggtttagaaatagcaatgaaggcaaggtcatctacctgaacttggtgttgctacatccatgttatttgtaactggaagtgatggataacatcacagtagaatataactctcaaaaggctttcattatgacataaacattacaaagcagtgctatcagtaaatgaaataaggagtacctaaacagaaacaagttgctgtgaattactcaacaaggtcctgtgtacttagctgacatgtggtgatggggtgaaaagaatgagtatgtgtgattcttcttaatattgttatttcaccctgattcaaggtacaattttatttttatttgcaaaatatctgagcctctaatttgcatatttataaagatgagtgatctatacttttgctcccaagccctgcagaacagagtatggagaaaacacaaccacctccaccaagtattctagtacacatagtgtacttgagatacagacaaggtttgagttttgcaatgtattactgcaaacacacagagaagaaactgagaatatagaggctcctgctgatgaattttcatgagtttgagagagcagtgttgatgtttgtagatgggggaagaaagagattatacagacctctgaggatgacggtctgaatacaggtggatgaacttagagacatgaaatcttagaggaaaaagatgaagaagtgtaagacacaagattagtcctgatggcctcttagcgaaaagtgggtaatacattttcattacatcttctctctcgggatcattctgtcaggataagagggtcttaacaaaagcacccaaagctcaaaaaccctctatttcaatgttttcttagtttgtttaacattatttactgacctccatgtgccatgaaccattatagttacccgaaataactaagtgataaaactaaaatctttgccctcctggagcttaaagaatatcaagggggagaaggttatgttttttctgtcaatcctgtgaaaaacctttatctattcaagttcaccttgatattatttgattggcaaatgctgaaatacctatatttttgctttaacagttttggtgactgcagagaaagaaatatgtgattatcattccatctttagacaaacctacttctcaaaggtgtcttgaaattcatgaaaaatgtacataattaaaactataatatcaccaaaaagaggatacaaggaacaccaatatataaccagccggaaaaaaaaattattttttaaataatgcataattctaagtgtctgcatttcccttggaatgcatcacaagtttcacataagtcatgtgtaaatatcacaacaatgagagctgaatccctttaaaataaggcaagtgcatgcctgaagcactttcaacctctgactaacatgagagatcaggaaacaaggagtagttgtaaaaggtcaatagatagcaggtttattggaaggggtgaattattaaagtaagcaaaaaaaaatacaaatagggtagcagagggtttaatgtttgaaactgagagtttggaggccatgcagaaccattatctggaatttgtttctctcccaaatgtcctctctaggtacttttaattaaatatgcacatacatacacatctataaccaccacctcacctcattacttgcaggcattttaaccagcaaaggtagtatttctcccatctcattgtaagcacatatactgccccaaattttccccttacaagaaagcaccatcaaaaatcacctcatcttacagtgtttggcaaacacagttcctgcaccaacatctttctgttgcttttccagtccctttgtaaaactgctaaacaattgtttcaagtccattctaatccttcattcaatttgtatgcgctatcaactaaatatcagaactttacagtcaattttgcatataaagttaaacacacacaatcactaccctcaaattgttcattaatcctttctggtctggcagcctgtctggacacactacatatttctgccatttactgcagtatcctattttatccacccatctcctctacaccatgagcaatcaaacagcaaaagtatagatcacttgtttttataaatatgcaaattagagactccgatattttgcaaataaaaattaaattaaatcttgaaccaggatgaaataacaatgtaaagaagacatcatgtatacccattcctctcactctaccaccacatgtcagctaagtacacaggaccttgctgagtaattcgcaaggataaaaaatgatctcacctaccttcctattttgtacttcttatttcatttactgatagcacggctttgtaatgtttatgtcataatggcagccttctgagggctatgttctaccgtgatgtcatccatcactgccaattacaaatactatggatgtagcaataccaagaaggatgttgcttcagaatgtctcctatgcacccaagaatcccaagttgcagatgaagcatcatatcattaaatattgggcttaagaagcctacaaatatccagaaaattctgtatgaatatagatcaagtgaacccttaaggaaatatttattctaaagggtcactttgaagaaatatccaatctatctgagtattcctaaactgagaaaagtagtttaactatatagaaatgtcaattgtagcaaaaactctataatttcaaaggggtatctatctccctattctttctggacatacagccagactacatttctcagccttccttgcaattaggcatcgccatgtgctgaatttcagccaatgaaaggagagaagaacgtaataggagttacttctgaaaccgtgccccaaagagttaaagaaaccagtaactaacagaaattcttgagtttgctggatggtagatgagaaaagaaacaagttgctgaaacactgaaactccctctgcttaagagataaaagaactggaagaaatcggctggaaccaatatggccaaatggagtttacacagaacgagcttgctgaggtcacaacctgagtttccactgcgtgttgcatagtaactccccacaaatttgcatatgggactcatgaggaggcatgaagagataactgtgtatgcccaatgactttccagatctcccctttccttccacaaatcactgctattcccaaaatccacccactaaaccttttttttaattttcaaaaaaattgtccataagttattggggtacaggtggtgtttggttacatgagtaagttctttagtggtgatttgtgatattttggtgcacccatcacccgagcagtatacactgaactctatttgcagtcttttatcgctcgccccctcccatccttcccctcaagtccccaaagtccattgtatcattcttatgcctttgcatcttcacagcttagttcccacatatcaataagaatacatgatgtttgggttttcattcctgagttacctcacttagaataatactctccaatctcatccaggttgctgcaaatgctgttaattcattcctttttatggctgagtagtattctatcatataaatataccagagtttctttatctactcatgattgatggacatttgggttggttccatgattttgaaattgtgaattgtgctgctataaacatgcgtgtgcaagtatctttttcatataatgactccttttcctctgggtagatacccagtagtgggattgctggatcagacagtagttctacttttagttatttaaggaatctccacactgttttccatagtggttgtactcgtttacattcccaccagcagtgtagaagtgtttcctgttcaccacatctatgccaacatctactgttttttaattttttgattatggccattcttgcaggagtaaggtggtatcacattatggttttgatttgcatttccctgatcattagtgatgttgagcattttgtcatatgtttgctggccatttgaatactttcttttgataattatctattcatgtccttagccctctttttgatgggatttttttttcttactgatttatttgagttcattgtagattctggatattagtcctttttcagatgtatagattgggaagatattctcccagtctgtgggttgtctgtttgctctgctgactgttccttttgttacgcaaaactctttagtttaattaagtcctaactatttatcttttttttattattgcatttcgttttgcgttcttggtcatgaaatccttgcctaagccaatgtctagaagggtttttccaatgtaatcttctagaatctttatagtttcaggttttaaatttaagtccttaatccatcttgagttgatttttgtttaaggtgagagatgaggatccagtttcattgtcctacatgtggctagcatcatttgttgaaaaagatgtcctttccccactttatgtttttgtttgctttcttgaatatcagttggctgtaagtatttgggtttatttctgggttctctattctgttcccttggtatatgtgcctatttttataccagtaccatgctgttttggtgactatggccttatagtatagtttgaaattaagtagtgtgatgcctccagatttgttctttttggttagtcttactttggctatgcgggttcttttttggttccatatgaattttagaattgtgttttctaattttgtgaagaatgctggtggtattttgatgcagattgtgctgaatttgtagattgcttttggcagtatggtcattttgcaatattaattctacccatccctgagcatgggatgagtttccatttgtttgtgtcacctatagtttctttcagtagtgttttgtagttttccctgtagaggtcttttggctgcttggttagatatattcctaaggttttttttttttttttttggttttttttttttttttttggcagctattgtaaaaaaggttgaattcttgatttgattctccacttggttgctgttggtgtatagaagagttactgattcgtgtacattaaccttgtatccagaaactttgctgaattattttatcagtgctaggagctttctggaggagtccttagggtttttaaggtaaacaatcatatcttcagcaaacagtgatagtttgacttcctctttaccaatttggatgtcctttatttctttcttttgtctcattgctctggctagggcttccaatactgtgttgaagaggagtggtgagagtgggcatccttgttttgttccacttctcagaagaaatgctttcaacttttccccattcagtattatgttggctgtgggtgtgtcacagatggcttttattacattgagctatgtcctgtgtatgccgattttgctgagagttttaatcataaagggatgctgtattttgttgaatgctttttctgcatctactgatatgatcatgtgatttttgtttttaattctgtttatgtggtatatcacatttatttaaagatgttctttgaaaccaatgagaacaaagacacaacatacaagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaacctagcagaaagcaagaaataactaagatcagagcagaactgaaggaaatagagacacaaaaaacccttcaaaaaatcaatgaatccaggagctggttttttgaaagatcaacaaaattgatagaccgctagcaagactaataaagaagaaaagagagaagaatcaaatagacacaataaaagatgataaacaggatatcaccaccgatcccacagaaatacaaactaccatcagagaatattataaacacctctaaacaaataaactagaaaatctagaagaaatggacaaattcctcgacacatacacactcccaagactaaaccaggaagaagttgaatctctgaatagaccaataacaggctctgaaattgaggcaataattaatagattaccaacccaaaaaagtccaggaccagatggattcacagccgaactctaccagaggtacaaggaggagctggcaccattccttctgaaactattccaatcaatagaaaaagagggaatcctccctaactcattttatgaggccagcatcatcctgataccaaagcctggcagatatacaacaaaaaaagacaattttagaccaatatccttgatgaacattgatgcaaaaatcctcaataaaatactggcaaaccgaatccagcagcacatcaaaaagcatatccaccatgatcaagtgggcttcatcgctgggatgcatggctggttcaacatatgaaaatcaataaacgtaatctggcatataaacagaaccaaagacaaaaaccacatgattatctcaacagatgcagaaaaggcctttgacaaaattcaacagcctgtcatgctaaaaactctcaataaatttggtattgatgggacgtatctcaaaataataagagctatctatgacaaacccacagccaatatcatactgaatggacaaaaactggaagcattccctttgaaaactggcacaagacagggatgccctcactcaccactcctattcaacatagtgttggaagttctggccaggacaatcaggcaggagaaggaaataaagggtattcaattaggaaaagagaaagtcaaattgtccctgtttgcagatgatatgattgtatatctagaaaaactcatcatctcagcccaaaatctccttaagctgataagcaacttcagcaaagtctcaggatacaaaatcaatgtacaaaaatcacaagcattcttatacacaaataacagacaaacagagagccaaatcatgagtgaactcccattcacaattgcttcaaagagaataaaatacctagaatccaacttacaagggatgtgaaggcctcttcaaggagaactacaaaccactgctcaatgaaataaaagaggatacaaacaaatggaataacattccatgctcataggtagaaagaatcaatatcgtgaaaatgaccatactgcccaaggtcatttatagattcaatgccatccccatcaagctaccaatgactgtcttcacagaattggaaaaaactactttaaggttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaatattgccacatatctacaaccatctgatctttgacaaacctgacaaaaacaagcaatggggaaaggattctctatttaataaatggtgctggggaaactggctagccatatgtagaaagctgaaactggatcccttccttacactttatacaaaaattaattcaagatggattaaagacttacatattagacctaaaaccataaaatacctagaagaaaacctaggcaatatcattcaggacataggcatgggcaaggacttcatgtctaaaacaccaaaagcaatggcaacaaaagacaaaattgacaaatgggatctaattaaactcaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagttggcgaaggatatgaacagacacttctcaaaagaagacatttatgcagccaaaaaacacatgaaaaaatgctcatcatcactggccatcagagaaaggcaaatcaaaaccacaatgagataccatgtcacaccagttagaatggcaatcattacaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccagcccattactgggtatatacccaaaggattataaatcatgctgctataaagacatatgcacacgtatgtttattgcagcactattcacaatagcaaagacttggagccaacccaaatgtccaacaatgatagactggattaagaaaatgtggcacatatacaccatggaacactatgcagtcataaaaaatgatgagttcatgtcctttgtagggacatggatgaagctggaaaccatcattctcagcaaactatcacaaggacaaaaaaccaaacacttcatgttctcactcacaggtgggaattgaacaatgagaacacatagacacaggaaggggaacatcacacaccggggactgttgtggggtgggggaaggggggagggatagtattaggaggtatacctaatgctaaatgacaagttaatgggtacagcacaccaacatggcacatgtatacatatgtaacaaacctgcatgttatgcacatgtaccctaaaacttaaagtataataacaatttaaaaaaaaaaaagagctaatgacaatcccaccaccctttgctgactctcttttcggactcagcccgcctgcacccaggtgaaataaacagccctgttgctcacacaaagcctgtttgttggactctcttcacacggaagcgcgtgacatttcttgtataatttttataccaaataaaccaaattatgtcatttttggactttagggaatctgatatcgtaaaagattaattaggtcagaaaaagacataatttataatttgattttggaatgtttgtcaaatatcaaaagtttaaaacacctgaaatcacagttcattgtaaaataagtcattcgttttaccaaagtcaattctggaactgaggtcttttcatttccatttcagggaacaatacactgttttactccaaaatataaagctgtaatttaaggcatttgtactaacttttaggttagaatatgtgtatctttcattttttaaacatttttaatccttcattattttcaatagatttcatttttagagtccctcatcatttttaagtaacaaattcttaccaatagactatatataaattttagtaataactttattatacaagcccaacatgatcttagtattaattctgcccctctctgatgttctttcttcatttaaaacactaagacattggccaggcacagtggctcatgcctgtaatcccagcactttgggaagctgaggtgggtggataactgaaggtcaggagttcgagcctggccaacatggtgaaacccggtctctactaaaaaaaaaaaatacaaaaataggccaggcatggtggctcgtgactgtaatcccagcagctcaggaggctgaggcaggagaatagcttgaaccttggaggcagatgttggagtgagccgagatcatgccactgcactccagcttgggtgacagaatgagacttcttctcaaaaataaataaataaataaataagacattaacatcttcctatgtcttgcagttatcttgaatattcaatgagaaaataaatatagcatgatttactatacaataaatgtattacactaatggtttaaaatttttaaagtacttgatgtcatttacagagaaaacatgtgtatgactagatttgttttggtaaaaataatattacagcaaagaaaatatatttttagaattaagatgaatccaggaatattccccaaaaagattttgaaaggggaactgaatttatgtggttacatggttgaggttatcaatctagcaaaattctgattaaagggcaattgtatctttgtttacattcacagtctggggacatcccggttatactacaaagaccaatttggcatttactatagaaaaatagaccttctgcttaaaactattgggaaattttcccatgactctcagtggaaagcaaagctacttttctcaagaaattaccatgattatattttatggacatcgtaaatgttttacctgatttctttctttttcaactttggctacttggaatctcagggcaaatttgttgtcaacttccagaaagtttacagacctatgtgatgtgggtttcttgaagcatccatgctgcacaagttagagatattaacttttcttcagtctacaagttctattgttaattacatttcatcatgctagacttcaatccaagagaacatattttctctcagagctcaatggcattattgatatcctacacaacaatatttccacagaaattttcaaggtaatctgtaagttctaaagcatgataagtatttcaggtggcattatcccagaaacaatatcacttccttctggataatcaagaagaagcacatacttttcataggtccaaagaaactatgatgattgctatatttcagtggaaatgagtataatacaacaggaaatcagacttcaaatatgttgctgcatgactgaatttaattctgctaatctacctctattaagaaaatattttccatctgtcacgtaaatctctgcactaacaataatttttctctactgtcacttttttaatttcctgtggccagagacattagctcttttatatattgttctagtaagtattgagtcaggatcttctaaagccataagttaattaaagattaatttgagtgactgttcctgtttcttaacagatgtgtgcttccatttatttgtgttcctcagattctttctggtcacaaaccactcagaaattgtctttcggttttgccagcgttcatcctaaatccctcagagccaatgatccattacaatgtagatcccactttgacttcagacatttggctggtgaatatgttggcatcaaaacaagaaagaagagatattcagcttttgacaaactgaattatcatcaaagaaagaagtggaaatttctatgttaattaggaatagaaccatcttcactgatgttggggcatgtaatcattcagcaacatattaagggctaagattagcaaaccaggagtatattgtattacacttaattaagtcatcagaattttttaaaggcagtgaaactccaacaaagtaaatgaaattaagaagagtcattcaaaactaacatcaactctggaagtgcagcttctttattgctatcccacctcacaaaggatttttaaaacactaagcacttagatatgctgtaaattcagcaacttgcactatgtcttgtacccagcagatattcaataaatgtaggagggagggagggaaggaaggaaggagggcaggagggaaggagggaaggagagaggggagggaggggagggaggggaggggaggggagaaaggaaggttggttgtaaacttcatgacctaaaaattataaatatacacatttttcaaatgaagaaattgaaacacaatgagataaaatagcttgtctcatataacccagcaaagaattgttggtatttggctttgaagtagaattacctgactattaagttcacttgattcatctctacagtgtactgtaacataaagttagttaagtgtatggtgattattaagatttggggagcaacatggaatgctggttaaaaactcactcaggcccctgtagggagacttaggtcttcactcagtgggaagacttaggtcaagccccacttagctagttagcatctatgtcatctatgtgtacaacagagataacaatagaactcattttatcctgccacgtggaatatgctaaaggtttaataagtaatagctgttattattaaataataatgtgtcaaaactacagattataggatcatctagcttaggaaaaattatgctcaaagcctagatttatcaaaaaaacaaggctgtaattttccattagacatccacttcaaagtcaagatatccgtataattttgccataatcaaaaattttgcttgtcattatatttttatttaattaaatgtctcaagttaataatggcaaggaccacatgatttttaaaacacagttgttctcatttagttcttcactggcaaaaggaacttcctaaaaaatgcatatataaggtcttgtaaatagtctactaacttaagataatcacaaagaaatgaaatatagttaagactgagaaactgcatgaaccttctgactattatccctcttccaccactagatttttctttcctgcttttttgaaacttagatccaaatcttaatagcagcactcattttcatcatccttcagaaacatctactcaatgaagacaactgtgaaaaaccatacataggataagatatatacaaactttcaagcacaaaacaataatacaatttcattatttcaaccaaaaaatagaaacatgaaacccacaacatatagcaaagtgatcaaaacagtcaagtgaaattttagatattctttacattactggccatgcatcgtacctgcgtgcatgtgtgtgtgtgtggtatttagcaatatttatttaattaggcacttttaattttaattatcatttttgttcccctaggttctcctgatcatgttagaattcagtttaaaaatatttgtatttcgcacatatggaggcctttgaaataaaatagaaaatatgatgagactagcaaataacaaaagatggcccattaaatcacttggaacagaaaaaactcgtgccagcttttcctttgaaataaagaggaaatggtgcaccacaggccccagattgtttttctgaggtgataggatattatgatttgttgtatctgtttcctcaggaaacagcaaatgttgaacaggtcaatgcttttcaggaatgaaaaaaaatccagaaaaagactgccaaattggcaagaacaactttcctatctttgaagagcatcaactcggaagttattttatttccgaatagcctttctcttattgccaacagaaatccattacaatatataagagctaagatttcttgtcccttttcacctttatttgccgtctttcaactggcaagagtcattttgaccagcagattaatcaactgtaagacagatcctcacacaaaggtaggtacttggaaatataaactgaatatttttactttgaatattgaaatttttctcaaagataacattttcaacgataacattttatgggcttttcatagaacattcattatcagcaaaaacataagtagcttacatgaaattgtaagtcattaaatgcaataaattttgaaaaattctggtttttacaggtcagagtaaaacattcatgttgggcatttgggccaatcggtccatccaagtacacaattgacttttcctcctgatgtaccttaaagttcttgaaacttcataaggatagaatagtctcaggtgtactctaaaagacagaattgctctacagaatatttttattattggtttttcttttgtttttcaaacttaatttaagaatggatataggaaaagtactagttaaaggaatagccacacccacatatatataattgaatatccagtgaaattttgtccataggattctttcaagacttgcattgctcagaccacacactcaacctatgtgcagagttgactaacaggaagccaatttgcaccatggtgtatggagttgctttcccaaaaatcaagctatcatgtacttgaaatatattgtaaaatttgacccaattgagagtagaatacctggacatctccatgttcttgccttggtctctgatatatggatttttggaagcactttgagaccactcatcacagcctaaattaatgtaatagaatgttgttaaaactaggaaatatattatgtgactcttcttttagactatatccaacagggtgattccttttttttttccttatttttaagctcttccaagcaataaaatttgtaacataagatctagttaaaatgttaatatctcaaacccatccatagaaatctataatgtatctactatttttaaaatatcaaaatgttcaaatgaaaataagtatacattttaaagtagttacttctaagggaaaaaccttagtcataaaagcttctattgctcagagcaatgtatgaacaactctttggcattatccccaggatcagtttacaagtcaaaaataaaaactacttccactattttgaagtcaaattttataagcctactaatattgccccacagtaatactgaattcaaaataacattaggcaaattccctaaaaatgctatagtaggatatttgtattacattatatccaagtgttgagacattttaaatagtactttttaataaaaaacaatcatactgatcacctattgtgcttactttcagaggcaactgaaaggatgaaatcactgacttggatcttgggcctttgggctcttgcagcgtgtttcacagtaagtatcattaatcacgatcacacttctttatagtttctcattaaccattacttcagatttctttttacattaatgatgttaccttttcttatatattagtaactattaatcatcaatgaaacactgtttagggcttaaatttaaatttaaaatctaatttaaataaccacacatgtctgatggctgccatactggacagctcaagtctgtggtatcagactgcattaaacagatacgtataaatgttaagttcccatactctagtcagttacacagtaggtaaaactctataaaaatagataatcaaaataaaaccgttttcccagcatgtagtttatggatcatttacaccagagtcacctaactcacttattaaaaatatagtaaagacctcatccaagcttcaataagagtatcagataatgggacctggaaagatgcattttactaaggatctacaagtatctttgcatgctaaattttgggagaatgctaagcatttatatataaacagctactttgtatacaaaaccaggttaaagacaaatgagatactaaatatcatacaaaattacaaaaatgtttttaaaacacacgtatttcaaagtagtagaatcatactcgatttcaaagtagtgttagattaattccagtgacagaaagagaatattaattccagagtaatttccaccaaagtactataaaatctatatcaaattgaaaaatatgaaagctgttttttttagattatgacttccacaaatcaagcaacataaatttacatcattctgaaacatgaaacataaaataattcctttttcatctactttgtttttttttttttttttttttttgaaacagactctcgctctgtcgcccaggctggagtacagtggcgcgatctcggctcactgcaagctccgcctcccgggttcgcgccattctcctgcctcagcctccggtgtagctgggactacaggcgcccgccaccacggccggctaatttttttgtatttttagtagagacggggtttcaccgtgttagccaggatggtctcgatctcctgacctcgtgatccgccagcctcggcctcccaaagtgctgggattacaggcgtgagccaccgtgcccggcctcatctactttcaaaaaggaacaaaatcaggaaattctaaggttactgaggtagtctgaccttggctaaattactgagagcattatatgttgacataatttttaataaaccaataaaatatattgatatattttaaaggtaatatcttaatggcttgattataaagcttattttcaatatttttattccctcagaatacaaaagaaaaacatttataatttcaaagtatcaggcttttattatataaatttttttttataagattaatttgaaaaagataactttctgggccaggcacggtggctcacgcctgcaatcccagaactttgggaggctgaggcaggtggtaacttgaggttaggggttcaaggccagcttggccaacatggtgaaacgctgtctctaccaaaattacaaaaattagctaggcatgatggcatgcacctgtaattccagctactccagaggctgaggcaggagaatcgcttgaacccgggaggtggacattgcagcgagccaagattgtgccactgcactccagcctgggtgacagagtgagactctatctcaaaaaaaaaaaaaaagaaaaaagaaaaagatagttttctgataacataagcagtttaaatggaaatcaacctttccccaacttaattatatgagattcatgatgattaataattattgaatgttggaaatatgaagggtagcatgtcctttacgtgtgtgtgtatatgtacacacacacacacacaaataaagcaagtctaactactattagtcccattaaaatacaaataaatttaggttcaaagtatccgtgtcttagatggactgttcctaaataaagtaatgtaggagattagtgccaattatagtccttcgagagcgtagtgtttcttcttaaaatagtattttcatcatttttctgagttcgttacctttagccagttgcggaaagggagctaatcaatgtgattgggtatacttactatgaagatttttcattacttaatattaagatcaacatcaggatatctttaggaggcgagggcactttcagctaattttttaattgtttcaacaataaaagtgaatggagtattttcccacactaaggatttgttttcttgacaattaaaaatcaagtcctgaacttccatacatcctgactagtctttggcttggcagcacttgggtcaaatgccctccataataccacagaatgtcattagctagagaagacaaacatgaggccagttctacagaagtgccttggtatttttcatttgttgtattagtgatcctaataaaacttttactggcatgttaaaggcagaagccaggttgaagagcaaatgggaaatgagaagtggagttggcaaatctagaataccctttcaaagtttcaaagtttcgctttgaaggaaagaggtgacaagaaaatcaacaacaagggtaccggtggttgaaactgaaccttttataagcagggaaataatataacttgatacttcttttgcaaatgatctatttaaactttctgtatattttaggtgaaagtgtaagagtagaatcaagcagtcaaatcaaggtgtcattacagtaatttgggtaaaaacaaatgacttaggttaaagtggaagtaagagatatgataagaagtggttagacttagaattcaggaagggagatgcaaagccaataggattgtgggggagaagggtgagtggaacataaatgatagttgttttctgaagaaaatgatccagtttataattcctgccatttaactggctcattttcctcagaaaacaaattccaatattatagttacaggaagtaaagggaagactgacagagccaagtccctgagaagacacttgtaaagaaacagaaaattcctagctatcaatgactccatggttgtgtggccagtaaatcagggaagttcatttctaattgcctgaaatatcttggtgaagcaggagaaaagccagtttggtgggggtaaatgatagctcaggatgaggtggagaatgttgataaaactggcatcaacttggaaaattacaggcctctggggaagtgggaagagataatctaagataagacactcaaaaaaggatttcaggcagcactgaaggacgctaactttctgatggtacagtgcttgtgacatcctctaccattgttaagaacctggaattaggaatccaggacagagatgctttgccgtaatactaaagtttagatttaacaagggtaataccagacaaataggtgaagggactgagaaccacaagaagtgaatgtagttttgtgtcctgtgtaaaccatctgctccaagcaacctggacttcttgtcatcagtagagtggaacttcattcttaccccagagcatttgtgtattttcattctgtttggcatgttctctccttattttatattctttaagcctcttttcaaatgacttcttctcactagaacaatccttcatcattttcctatccagaactgatcgctttaactccttaatgtatttgttccttgcactacttttcagctattttttttttattttttaaaatagagacagaattttgctacattgtccaagttggccttgaactgctggcctcaagcaatccacctgcctcagcctcccaaagtgctgggattacaggcatgagccaccatgcccagcctcagctatttttatttctaaaaattgtgctctatgtaaaccatacttgagccaatcatcactctaagcattttacaggtaatatttcacaacaaaaatctgacaataacaacaggaggtgggtccttttattaacgtcatttttctgatgagaaaaaagagactcaaacaggattccacactcacccaacctctacgtgccagaagcagaactcaaaccctcacatgaaatcccagagactcattccactcatttcatttccctttagatcatatttatcctgccttgtattgtaactccttggcctgtagattcatagaagatctgtttgtaaccctggatccccaccacagctcctacattagctcattgcacaaagtaggtgctcatgacgtctctcacaatttattagtgttcaaagtctgaacagccctgaactcttgaattagacataataagacatttttctcatcctggaagggcatttatttccacttacaattgacttaaatgacagattcgactataggcaaaggataagatttttgctcattatatatatttttttagtcaatactatccctgctttcattgagagcctacgtattcagaaagcaaaagagaaactttttttctttgataatagactttcagactatgtgacttagatacaatgtaatggttttctattgctgcataacaaactaccaccaattagtagcattaaaaactcattattatctcagtttctttggccacaactctaaacttggcttagttggcttctctgctcagtctcacaaggctgaaaaggtgtgcccactgctgtatttctttttctgcagctcagtgtccttttttaagcttgtatggttgttggcaggattcagtcccttggttattggactgaagcccctacttccctgctgcttacgagccaggggccactctcggctgctatagccagtctaccatgtacctccacatggccctccccacaacatggcatcttgattcaaagcccagagaaaaacatttactgcagcttcaaatctctctgatttcttctgtctctgacattgtagaaccttttttaaaagggctcacctgataaggtcaggccagcatgtgccagcagggagtagaaatcttggggccatctcagagttctgcttaccacagaaagcattcacccttatatttaactgtgaaatatctgatttgaaattatttacttcttatttccacagcctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcaccaatatgaagtctccactgttgtcatcaaagccaacatttttcccccagttatgtcacctaaatgagtgaacatagatcatttgaacccttaagaaaatatttattctagaatcactttgaagaaatatcaaatctcttagagtattcctaaagtgagaaaatagtttaactatcatagaaatggtgattatagcacaaatctcataatttcaaaggaatatccatttctctattttttctggacctacaggtagactacatttcttagccttccttgcaattatgcatggccatgtgctgaatttcagccaatgaaaggaaaaaagaaacaaataagagttacttctgaaactgtgcctgtgatggttaatattgtcaacttgattggattgaaggatacaaagtattgatcctgggtgtgtctgtgaggatgtcaccaaaggagattaacatttgagtcagtagggtgggaaaggcagacccacccttaatccgggtgggcacaatctaatcagctgccagcgtggctagaatataagcaggcagataaaatgtagaaagagagactggcctagcctaccagcctacatctttctcctgtactggatgcttcctgcccttgaaaagtagactccaagttcttcagtttggaattcagactggctgtccttgctcctcagcctgcagatgacctattatgggaccttgtgatcctgtgagttaatacttaataaacttccatatatatatatatatatagacacacacacacacacacacatatatatatacacatacatatatatatacacatacatatatatatacacatacatatatatattcctttagttctgtccctctagagaaccctaacacagtgccctgaagagttaaagaaacagtaactaacagaaattcttaagtttgcaggatggcagataagaaaagaaacaaattgctgaaacactccctctgcttatgagatcaaagagctagctgaaatggattggaaccaatatggccaaatgaagccacagcagggaatttattctccaccccagatatgaaatagttttgatgaaatataactgaatgaaattaaataacataggattagatggaatgagattaatagaatggaatggaacaacagagtgcactgtacttcataccccttattctgacaaatacattcacctttatgcatactgggacatgttgttcaatgtatttcttaactgttattcataataataaaaattttaaacacttatttagggatgagaaagaatgtcactttagtgatctaccattgaccctatgctgaataaagagagaaaggttaaagagagctgatggatcgggagaaagtcatgaggtcaattaactggtgtttccagtgggaatagttaaacttgtaaacttgaaggagaggcagttgtcattctggagtgagatgtgtgaatgagcgatttagaaataagaaatgttagtgtaactgcaatccaatgtgtgactgcagcagtgagtagctgaaatagagaaaagtcacaggagattagatgcaagatgagagaagctagggattggatgggacatccagtggaaacagacacatagaccaatagaacagaatggagaacccagaaataaagccacacatctacaaccatctgatctttcacaaagtcaacaaaagcaagcaacaaggaagggagtccctcatcaataaatgatgctggcgtaactggctagccacgtgaagaagaatgaaactggaccgctatgttttaccacatacaaaaattaactcaagatggattaaagacttaaatttaagaataaatactaaaactgtaagaatcctagaaaaaagtttaggaaatatcattctggacatttgccttggcaaagaatttatgactaagtccttaaaagcaattgcaacaaaaacaaaagttgacaagtgggacctaattaatctaaaaagcctctgcacagcaacagaaacttctaaaaagcctctgcacagcaacagaaactaacaacaaagtaaacgaacaacctgtagaatgggagaaaatattctcaaactatgcatctgataaagatttaatatccaaaatctatgaggagcttaaacaattgagcaaaaaaaacaaataaccccattaaaaaaataggcaaaagacatgagcagacacttctcaaaagaagacacacaagtgaccaaaaaacatatgaaaaaatgttccacatcactcatcatcagagaaatgcaaatcaaaaccacaatgagacactatctcacaccagtaagaacggctattattaaaaagtcaaaaaataacagatgctggcaaggttgcagagaaatggaaacacttatacactgttggtgggagtgtaaattatttcaacaattgtgaaaagcagtgtggtgattcctcaaagagctaataacagaactatcatgactatgtatatacccacaggaaaataaatcattctaccagaaagacatgcacctgtatgttcattgtagcacaattcacaatagcaaagacatggaatcaacctaaatgtgcatcaccagtggattggataaggaaaatgtgctacatataaacatatagaatactgcacagccataagaaaggacaaaatcatgtcctttgtgcaacatagatgcatctgcaggccattattgtaagcaaattaatacaggaacagaaaaccaagtattgcatgttctcacttataagtgggagttaatttgagtacaatggacataaagatgggaacaacagacattgggaactattagaggggagagggagtgagaggaggtgagggctgaaaatctacctgttgggtactatgcttagtacctggatgctgggatcattttcactccccgctcagcatcatgcaatatacccaggtaacaaacttgcatatgtaccccatgaacccaaaatgaaagttgaaataaaacaaaagaaaagaaaatttaagtcacccagcatgacttcaagcaaatagcaatataactgacaaatgaaatgagaagaggtgatcacatgagcagaagtcagagtgtagaactgaatggaattggcctcaaaggagcatgtgttgcctaaggaggtgaaggagaaatattgccaactataaaattttagcttttgttttcagtactctgactttgagggagtaacagatcacatttacaagtggcatattgctatagtttagactggccacagtattcccatagaaatatccctctactctgagcctctagcacagccagtcatgactcatcaaatacatcagatttccgtgcaatcaatctatcattaaagtttctctgaactgaggttttccaatcacactcaaacttgtttctcatgaccatatacatcccaggttcagaatggctgggacataggaagctgtgcctaaagtttaccaattctccagcaagctattgtcaagcgtgctatgttattacctgttctgtatacattttaagtaaacgctaaataaacttggtatgtgatgcatcttttgtctagtgagtttggacatcatcctgagcccaagactattgctactaatggagcctagtgggtgttgcagccatcagtcactgcatcagttatggtgctgtcaggaggcagcaatactgccaattatttttaaaagaatttaatatcaagtatcattaattaggcagcaagaattgttaacggggtaactgaaaaggcaaaacgagaacaccggatttacctcatggaggtagcaactgcagaaagaagctaagactcctagggctaaggaaagaagggtaaagtttgaaattattgaaatttagaagtttgcagatgaggtcccacagtatgaaaagcaaacctatgaaaaagtagacttgtgttggtctctctatgtatacaggaatggtcctttttgtctaagacctagtccagtagggaggaatgctggaaggttggtcctggaatctctgagaggatttaatgaggctgcttttgtacgtgttggaaaaacaacagagttcaacactgcccaaggttcctttccaaatgcttgactcagaccttcattcctgaagtatctcaatcctcagtggttatacattttcttggttgtagtagtttccccttaattttcacttttggacatgaacatactaaatggtgtcccagagaatctcctgaattccagacagtcctctgtgttcctctttgttagcagcaacccaatttccccctcggtaatcaggaacaatcctgctaaccagtagagtaactcttatttatttttgttcagtgacatgaggagatcaaaatgtcctaattcctcctttatgaaccaagacctccaaactagcataactcaaagttacaaagacagaaagcaaagattctgtgagtgggctattagttgtaataataagaagagccttaatttctgttcccatgaattctggccctgggaaagctggatgcatatgttgctcactgattgaaagcatgtactgcatcctgtaaaatagaacctcattcttgcagggtatatactctcaactggtatcataaagtcttcagtggtcattacactgttttatcagattagatgattctctgtgatggggtatgtggtaagaagaatgaacttcatatgcatgagctcataatcacattcttttgctgtgaaatcagtttcttgatcagaaagatgtcatgataaataattttattcaccaacagcagtgagactacaccagcaacttgaatttccttaacaaaaggcaattgttgctttaagtattgttccagaaaatatctagtcaagatcttttaaagccaggtgttaattaaaatttctcttgaataacagttcttatttcgaaaagaaatgtgctgcccctgctttggaaactaatcctttgttgactataagtcatgcagaaattattttaattttgataatgttcattcttaagtccttcatatccaatgatccattataacaacaaatcacaccttgtacttaaaacacttggctgaaaatatactgggcatcaaaacaatttacaacaccaaccaaaaagagaagttgttcatctttttcacaaaatgagcatgttactagagaaggtaacaattcaggaagtattagatattaacttaaaggatttcctgagtcatagaagggtacagaaaacaaaactgtctataatgagcatactaaaaaaggagacaagagttctaattgtcaacttatcatcaacaaagacagaggcaaagaaaactaggtagcttaagatcaattccaacttaattccccattcactaccaaaagcttttaagtcacgttttaaatttgaatatgttttacccctttactagagattcatcatacccagaatattttaaaaattgcatgatggaagaaggacattcccactgaaaggctaacacttactaataacgtgggtcacaattttctatgtcctatttatttaatcctcagaacaatatcaagaagtagacatattactatcttattttgtaaatgacagtgttgagacataattggattaaatagctggtcatataaaacacagctaataggaggggagttgacatttcagcttaggccacctgacttgaatgctacacacaatcactaaactaccttataatgaaagactcttacattttattggctgcagctgacagaaaacatatatttttacataataacccagtacacccatatgtataaccatataatatatcctgaaaagtattaatatataatgcaatctgatatttacttctattctgctctatccatcctctaaattctgtttgctactccctaaatagatttcatgtattactgatgagttgcattcaagcgtcaatgagtgctactattaaaaatatagtaattacttcagtggttcaaataattggatttgagagacaaagcagcgtaatgaagggaaaagttcaagctctcaaatatggcaaatttaaggtcaattcctttcccagctattttagtgaatttgagcaacttacgtgactcctctctaatttattatctaatcagtgatctgataataataacataaattgcaagggtttgttgtgagcatgaggagagctaatctacataaagtgattagcacatagtctaggacatggtaaggattcaacaaattatggctattagaaaataaagcataacatcttctagcatatggtaatttcctctcaaatgaatagattttatttcctatgagtaaatttctcagtacctgccttcattttatacataaaattgtgtaatttactacatccttttgccataaattgaaaatagattgtgtaatacctcccatctttggtagacaagtgtacattgaatttatccatctgatttagataatgggataacaccacatacttacagaatacaacatatattggagaatttattatccattaagcagtccagatattcattattagcttcagaaaaatgtattaagtaatttctatatatttaacattttaagtagctcaaatgcatgtatacagtatctttaaaattacacatctgggaaataaatatgaaattgaaaataagaaactagaaggattctatttcctaattatctcccaccactagatatcttctgttatttccaaaattaagacaaagaatttatttcaactgcctcctttttccattctttaaattccttcttcccaaataagcttcttctcaaataaaccaactcttactatacatatatatatgtcagttctgatacatatgtatagacacattaaaactccagtatctatagcctttaacaacagtggttcccaaacaaagcttcactttgcaataacttggggagttttttaattcttgtgttcttttgcagcaacgtgcatgcaggtggaagccattatcctaagcaaacgaattcaaggagagaaaaccaaatactgcaagttctaatttagaaatgagagctaaacattgagtatacgggaacatacagaagggaacaatagacaccagggcctacttgatggtgtagagcaggaggagggtgaggatcaaaaaactacctgttgagtactgtgctcactacctgggtgatgaaataatttatacaactagccccagaaacacacaaattgctcatgtaacaaacctacacaggtacccctgaacctaaaataaaagttggaaggaaaaaactaacataaataaaattaataaaatttttaaaacaaaattaaattactttgtctgtcttctgccccataacttttgataaattgttctggggtaaggtctgagaagtggaattttttaaagcttcccagatagttgtgatgtgcagtcaagtttgaaaaccactgtacttgagcattctgtgtgctgccccagggcctgctaggacagtgattggatcacagttctatagatgaagctgccaaactggcaactgcaactattatttctttgtttcagtaaagaatatcaatacagaactttaccctctctcaacctttctcttaactccaataaaaatccagacagaggtatttaagaagaaaggcttttctatcaaagttctttctcttcttggacttttaaattgtggctacctaaattgagtatctggcaagagtaagattaagcagtaatttgttccaaagaagaatcttctaccaaggtaggtatatagaaatataaatgtaagaattttcacttcggaattctagcttttgctcatattctcaagaatatcatcctcatggcttttaatggaaatagcctcgttacccaaaaatctcagatgtgtttttaaaaaaaaaatcattgtctgtggtaaaattgcttaaaattcctgaaaaaatgtcaagaacattcatattgattagttgcacaatttacatccaatttcacaatctattgactttttccactgctgtattttatggtctctaaagtcaatcatgagtagaagagtcttaaaaaggtatattaagttagatttgcatttttgttgttcttgtttgagttaggtttcttatgtattgtcaaactgctttctaatatgaaaacatataagaaaaaagctattttaagggggtagacacacgcacatacaactataggatctgtcaacctgtcttacatcactttcaaggctaatgccaatgacagataccacataaaccccaagacaatctgtcagcctatgtgcttgaattttgccttcccagaacccagggtgccatgtgcttcttatatattgttgaaaattataaacaaattaggataaaaacatcttttttctaattcacacactgatagacaataattgacttttggaataacttggaaaaaaatcatatcaaagtaataatacttcagtagagtgatgttaaaggaaaaatacacattacatggtttcttttgcttcagacagatctaataacaataacacaataattgtattaagaagttattttttacaatagtcgtgtcacgttgacaatatttaggtcacaaatctatagaaatctgtaagctttgactaattttaagtaaacatactaaaagtataccctaagtagttatgttccaaagtagtcaccactaaaggcaacaaggaatttccaaaaatactttaattttaaaatgtactttcaacaattatctgaaaattatctttcataaaataaagtaccaccattaaaaaaaaaatcacaaacatgacagtattgctgtgcatctatgctgcttcctctccccaaaatatcaaacacatctttaaaggttatgttggtctttcttcatcattttacataacaagtgttaaaatgttttaaaaaattttttctgaaaaacactgttgatcgatttggctaactgtggataatctttggcctgtttgtaggagcaactttaaagaatgaaattaactttcttcttgggcctgttggctcttatttcatgtttcacagtaagttccctcaattctaaatttacttgttatatttattgttaatcatgatttcaaagaaagttttgataccaagaattttgtcctgtatataaaaatacagtgtcaggctgttgataattatggacttgctcttactttccttttcctttctcatttatgactaaccatctagtcagcggttgctaagcatgaagggacagtggactgcaggaagaggacacagggcaggtagtatctaggagagctagctcttatctagagatatctcttcctttttatttctttttcaaaaggactactatcaaattgtcagaaaaatataatttaagcttactaaatgtttaaaagctgtagggaataagaaagcatacagttggagcttcatgataaattttctaaaaagacaacatgatatatcaatgcaaggattgctgattgtacaatagttttttattgaaaatatttataaaaactaaaatcaggaagcctttctgatgcctgaaaatatattcattatgactaaaatattcctttaactgactggaaattaaagtgctactcacttgggaaaaaaatacaaacagaaaaagaagtcatttactcaagaagcacttacactaattcaaacttttgaaaatcatttgttaaagctctataggagatccaaaaatatataatgcaaagtaacaagtgataagtgccatagccaaaaacatcatagcatgatacgaatttcagagtaagatcagtttccctagcatatgttggggttaggtgggcttgcgaggagagaaagagccctatttatctcatttcttagtaattactgataatccactgtgtgttgggcctagtggtggttgatacagaaataccaaagtcgaattccaaattgggatcttcatagattaggtcttcttttcataatatagtatctacctaagagaaactagtgagcaaataaatatcaatagaccctagcaatgatactgtcagataaagtaacgttatttttctgaagcattttttgatatttaatgacatctgtattgttctgaagcatatagtgctatgtaataacatttgtataaaaaaattatacttctgaggttgaaatagaagattattatactccatgagatacctatatcagaaacacctgatccacttaataagaatgaacatttccagaccttatcccagacctgagaaaaaaagaatagctgatcttggggcctggaaacctgcattctaggatactcttactcaagctgaaatctgagactccttgagtaaattttcttgaaatttacttctcaagctattatgttataattgcatgaaatatataaagagagctttcaaggtaaattcaacttaaatcaatccatcatatgaaaaaacctaagtcaataattagaattaattatcaaatttattactctggaataaaccacttttttggtagaattccccaaatatgacaaatatgacttctctgttaacattaataaacactaattcagactttatacaatagattagaaggtaaagaaagatccatgatcaagtaaacttgagaaatttggggaaatgaaatagaggttgttgactagaatacttctcagagacaataatagaggaaatgctgtctttgattctctatctacaaccttctgtttcatactgaggacagacaacttctgaggagtcctacataaagcatctaccttgaggattcatatgaattaatggcatatttttattccagaagcctgaattgcaagacaaatgtaacttaaattcttttctaccttgaaagagtatagaatcccatttatataagaagcagaggattccatgtcctaaaaaaacatgagtttaatacataaattttctcatgttagaattaaatattattggatataagaaaacaagaaccacaagacataattttaaggtcactctagcaaaaatttcttgctgtattcattgtctcatgagaagttggtaaatcttaacaacagtcttaagcattagtctaaataaagaaactttattgtacttagcatctagaactttcaatatatcagagattatcttttatgagatagggactatctaggatttaaattaaaaataacagttcatatttgtatatttacaatgtactctggagcacagttttaccctcaaacctcacaaaaacccaggaactatttgggatgctcctttacatagcacagagctgaacatgagacaaaccctcaataagtattaggggaatgacacaacaagtgaatgggcctttgtgtagttgacgccaagtaataacaaataggtttcagagtcttacctgttcattcatgccattggataggctatatgaagtatgacacagggatggataataggccaagtgtaagctcaaaggtaaagtatctcatggtggacaaggatatctgccatgctcacaagatgagtaacgacagcatttttgccaatacctgccatccctaacttagagaagactttgtttgcagcacaatctgtccactaaactgctgtcagctgtcagttggttaagctgtcagtctggcagtttctaatccttaagaataggaaatagaagtttaaaaaaagtaaaaagtaaaataaacttaaaaacagaacataaataaaatactttacagaaagggctatgataaaataattgccaaaagcaaagcaaaacctttagcctgaactaaaccaacgataagcagatatcaaataaccgaagacagacagtggttctccaaactctacaaactctagaaactctatcaggaacacaaatcatctagggattttgtagaactgcagactctgatccagtaggtctgcctgagccccataagtctacatttctaacaagccctcaggtgatactggtgctgatctgttggtcagcaaataacattttgagtaacaaggccctggtcaactgagaaatcaaacagagaaaggctgaggacttcttacgggtttgtataaatgctcaaatgttgtcacgggaaaggattacgctccttgccatgtgcaaggaaggaaatggcattctgaaatcaagtaagagaaatttctgcttatcaccaaatatggggaattcattcaacccaaaatacttattgagcacttattgtttgccaggcactattctagatgttgggtaaacagcagtgaacaaaacagacaaaaagtttctaacctcatggagcttatattctacttggggaagacaagccataaacaaaataactgactatgtaatgcagaaaatttgggaagaaggaattttaggaggaggtagaacaaggatgtgattttagatagggtagcccagtggaaaatggcatttgattaaagacctgaagtgggtgaaaaagccaaccatgcaagcagaggaaacagggagttccaaagtctggagtagggtacacttgcctagtgtgaagaataaggaggctagcatggctggtagagagtgagatgggaagagaggagcaggaggtgatactagagagttagaggagggtgaggctgcatcaggtctcatgggcttttgcagagccttagttttactctgagtgacatgcaaaactttagtacatgaagtcagtacaaaacctcagaaagatgccgtctcttcccacacactcttgctttccatcatccataatgatttggagaaaaaaaatgaaacttctaaaatatctgaatggcatccataaatatttacttaaagtcacctacagcttaagaaggatacaaacactgataaacatgacctctaacttcaaggggtatatgactgtcagaggatacaagatagattggtaataatagccagagcaggagttgacaaacttttctgaaaagggccagataacaaatattgtaggcttctgtgggcctgtaataagtggtcaacttggctgaggtagcttgaaagcagctacaataaacgaatgggcatggttatgttccagtaaaactttatttaccaaaacaggcaaactacatttggcccacagccttagtttgctaactcccagtctacagagacagtgaacaaggcaatatggcatgtaaaaacctgatatttcatttacaaaataatcataaaattaacccaacattattcatgagtttgcaaaaaatatttatgtttcattgaaacatgtttgcatgtttgtgtgcatgcaaaatactatgctaaattatttgtcattttaattattttttctaaagaacatcatgtgatagatactattactttctctcttttaaagataggaaaagtaacagagaggttacataacttacccaaattcacataacttgtgaatggagaaacaaaattttaacttgccttgatctatttgcctatcttctgccttttcttctattatctgggatggactaaaatcaacccaatatattctaagaccaacccctcaacttgtacactagatcccatcctctcccctaagcaaggagattcctgcaattatcctgcaattatctactctaaatctaaatatcagcaatttttccttctctctattgattgttcctactagcacataaatatgaggtaatatcatttatatgtttgttttcatactccactgatcttatggctcccatcatggtccatttgaaaaagttgcctctgtacatcttcacttcttttcctgttctgtcttaagcctactccaagcagactttgcccacatcatttggatgaaaccacatttgtcaaattgtactcaaaatggccaggcgtaagggtcagctttcagtccccatgataattatgtctaaattgtatttgacatgatcagtctcctacttaaagagttttttctttttcctcaactccactctcctgatttttctcctacttcaatgacgactccttgttggtctccttctccagacacatctcctcttcctgatctctaaatgtcagagtctcccaggacaccatcttcttaccctttctccatctatgagcacaaatccagttgctcaagccaaaaaaaacttgaaatcatccttgactctatcacctcccagatccactccttcagcaaatattgcccactctgccttcaaaacatcatctaaatcttaccctttctcaccaccctcctgctaccattctaggccaagccatcatcacttcctacctgtggcaacaataactgatctctctgctttcactattgtccctgcagtttattctccacacaacaaccagaaagatgtttttccaaagtaaatattgccatatcattcctttgttcaaaagcttctaatggttttccataagacttagaaggcggggatacaaagtccttacccctacctacaagaccctgctttgtcctccccgcaccttaactccaatatatctatgtaacaaaattgcatttatgctctttaaatgttttacaaataaataataataaatttaaaaatatctgccctcatggaactcacacattaaatcgtttttgattattttaaaccatcaaatgttaaaactacagagagaatataatcaaatttaaatataggtgggctgcataataataatattaaagctaccacttatggagtgtttaatatatgccaagaagtatattacaaaagtatgctgtttaatctctccagaaatccagtgtgacaattattattattatcctctcttaacaaataagtaaaatgaaactcaaaatagccaattctctattctgtttcaaataagcttatcatttgtgaaggtaatccccccaaatgtagactccttaagaaggcattttcatcatttgtctagggttataatgttcactaccattggccagtggaggagggaaactagctagtgaaaaattgtattaagagaataggaaaagataaaaataataagaatggagatcaggggtcagctatttgctgtaaggtgtaatttttcacatgatttctccccacctctgcttagggtccagagagcagctcattgaagatcactttgaacttaatttccatgacactgtaccatctgggtttcctcctgtctctgattttccttcactggctgctcacctttctcttattgatacccaagtttctgtcttcagccatttcttcttcattactttcttacttattgctttgacccaacagtgctttccaaatctatttctccagttctgagatttcaatctgcatctacaaacttccatgacttttcaaactcaaaaggattaaaacttaattaatttttttcctcttgacacctatatcttcattaatgttagcagccatgacttaagatctcaatttcatttgagtccacattcatttattcaaaaacatttactaagaacttggccaggcatggtggctcacacctgtaatccccgcattttgggaggccaaggcaggtggattgcttaagctcaggagttcgagactagcctgggcaacatagcaagaccccatatccacaaaaaatacaaaaaaaaaatagccaggtatggtggtgcactcctgtggtcacagctacttgcgaggctgaggtgggaagatcacctgagcctgggggacagaggttgaagtgagctgaggtcacaccactgcacgccagcctgggtagcagagcatgaccccgtttaaaaaaaaaatgtactgagaacctccaacgtgccagaaactggagatagaatgataaacaatacagagacattgtttgaagaagttaataattactacactatataataagtgactataagtattataatagaagtgctaaagcaacaaaaagaacaaagatacctaacttacttcgaattcctcataccttttattattcacaaaggtgccaggcactgactaagatactaaagacacaaagctaaagaagatacaacttattccttcaacagcagtaaaatagcacatggcctaaaagtggagaaaaatatcaaaacaaacaattactatcactgtgaaaaaaagtgatgaagtttgcttttgtctccaataaaagatttacaaaagtaaaattttggctgattttatattgtataaagatattttctgtacaattcttttaattatcatatcaaattattgggggagaggagtgaagccacttaaacattttgaaggaagagcttgccaagtgaatggaaattagggcaggagtgaaacattctcagctagaggaactgcttttatgaaggcacagggactaccaaaaagagctcgttatgttgaaagaactagtactagttctacatggccagagtgaggataaagaagtggcaaaagatgagattggatggcggtataggcttttgtttggttgcaaagaacagggttccactcacaatatttattcttgcatttttagggctgccttagtttgctgcaccagttctaatttatatttattcttgcattgacttcctttttccttaaaggaaggaaacatgcctggccaggttctcaataaatgttttcttccttccttaaataagaaagtcaatgcaagaataaatataaagtagaactggcacagcaaaagcaggcagccctaaaaaccggtctttgcttctcatggcaaccctgcttttctctgtactgttccctccctgagatgtgctctctttactcacagtccctgtgtccttatagcttagtttgcacgtggcccttattaatgctccagcctctgtctggctcctctcatctcacaatattcacattttagttcctacttctaagtaggatatctcaatatttcctatttcaagttacaaagagaaagagaattttattaacgtggcttatttttcttcttctggccataaggcctaagatcctggatagccagtggtttggaagtccatggaacaatagcccagaaataacccaaataaatgtgtttatgtttatgttacaagaataaaaggtgatgactaagacaggacagtccctggaaagggagaaaacatagatataaaatatacagaggaattgatcatgtgaccatgacatcactatggctccctctgaaatgacttggaatttttgagttgtcactgatctttgtaagagattcagttaagttgtgtgatggggacagtaaccagataaaagggaaattgagaagtggagacagaaaatctaaaccagccttccttactatctggctaggaatggagagagataaactaataaagaaagcttcaagggtaccctaggttaagaatgagattctttaatacatgagatatcaatcaatattatagacaggaagaatacagccagggattagaaagaggtttattttacaaaaataaaagagaagaaagaccctagggacagagaagatgtagatataaaacacaggtgaagagactggtcttaaacaggaagagagaacagcaagatatttatgagttttataggcatagggcaggaaagtgaagaagttctcacgtatcatggcctaaattatgtgaattagaaggcaagatcatcttctgatgggtgtagaggggagcaagaaaagtagaagtgaggtatagatgctgagaagatagccttttggggaaaatgggaggaaatgatttagcagtgctgatgcaccagacaaacacagacactatagttctctagtgttgctaccattagagattgtggcattctccagcaatgttcatcaccatggaagtaggactagggaaggtagtttgcatagagttgatccaaaagtttgatgtttctgaaggcaatatggcagagacacaggaaggagttgaatgttgtaggggaatgattagagtcttgcaccttcctaaagctttgtttcaggcaaactggtcttctgatggtcgctagaatagaacctatattttcttgaccttgttcatttgtttatgatattatcctaatttggcttcttcctcctcatttctaccctgttattttatcctcatttcaaatgccatcttctctacatggcaattagtcctctctctttgataaaaattaaaattttcatctaaattactaaaattgttacaatatttatcaattatttcttgaattgctaccatctacaagccatgcttgttattaatagagtacaaaatcactcaaaattatactgagcccttactctaccttactatgtctaagcactttacatagattatgtataatcctatctaccactataaatggtaagaactatttctagaaccagttgaggagtgagcaaacaggcagagataaccataagcaagtcacccagctagcatttaacaatggtaggactggctctaggaggctctagcaatcagactccagtgtctaaattttaaccaacatactatactagctccataggctttttgttgtattgccttgtattgtcattggagggttatatcttccactgatttcagactcacataagcagagtcttaaatctgtttctctttgtccctagaaagaagtgttgcatgtaatagttatacaattaatggttcagagtctggaatctcactgaattcttagaatgaagtaagaaagaattttcccagatagtcaacctgggtatttacctccacttgaaactacattcaaaggtggtcttttcttatacataatcaaggtgatttggtccctccctaaaacctacaggtcagatagcaaggttaccacttttttggttttttctcatttaatactattctacttttctttgattgcccaggcatccagaataaacaggaaattttctattccttattttttctaagttattttctcagtgaaatacatgacttatggcttagtatatcctaatgtttacatagtagatatattaatacatagtatatcctaatgtttgaactttaaatgatcaaatttagaaattttgttttttacctttgtttttatctccacagcccagtgagagtcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaataatatgcacctattgctatcattatgactaccactctatcctatattttctcatctaccaacagttgatgagacaggttcccagaagaaaacagagaccctttatgggaaaaaaaattaataaagggtttatttaaagagagtggacaggatttaaaaaaaaaatacagggctgagacattcagggtctcccagtagagctggtcatgggcctatgtttgatgaagcaaagggaacaaataaggagcccagagcctgaagaagagttgggacaatgaaggaaaggccacacaataagacccgttgtgcaaagatgtgactgctgccaggtgtgactactgctcctcattagcagtccactcttctctgcctagttctcaatcctgggaggataaccatacaaactcttacatgtgggttttcttacctgggggttctggttgggttctgctgatgaaataggtggaagggagaggtacaaatcttttatatttggtataaaagataaaatatggtccaactgtataggtcccttgccatgaatggagctaagctaagctcctaatagttacacaattaatagtctcctaatagttacgtgattaatggttcagagcctggaatctcactgaattcttagaatggagtcagaaagaattttcctagataatcccactggagtgtttacttctacttgaaactactttcaaagatgtgactactgacaggtgtgactgctactcctcattagcagtccactcttctctgcctagttcttagttctctgatttcttagaagctaagctccattcatggcaaggaacctatatggctgtaccattttttatcttttataccaaatagtaaccctacgtctctcttccacctatttcatcagcagaacccaacaaaaatctcacaggtaaggaaactcacgtgtaagagtttgtatgatcatcttcccaggattgagaatgaggcagagaaaggcggactgctaatgaggatttatcagcacgtaggctaacaccacaagtagcctcactcagcatcttgaggccaaacaagcagacaaggaaaaatatgagggttcctgacttcctacatagaaagggcagagacagcagaaaaatatgagatcagttttttattgcctttacccaggaaattcacatatatataaggtcaaccaggtaacaaaaatgtaagcaaataataatataaactaagagaaaagaaagaaaataattaaaatatcaacttaaattgatctagtggaaacagacacatagaccaatggaacagaatagagaacccagaaataaagccatatacctgcaaccatctgagcttggacaaagtcaacaaaagcaagcaatgaggaaaggagcccttaatcaataaattatgctgggataaatggctagccatgtgaagaagaatgaaactgaacccctacctttcacttgaatcctacacacaatcataaactaccctataacaaacgacacttacattttattgaccagaccccatctctacaaaaaaaaaaaaaaaaaaaaaaaaaaaaaaaagaggccgggcgcggtgggctcacgcctgttatcccagcaatttgggaggccgaggcgggcagatcacacggtcaggagatcaagatcatcctggctaacacggtgataccccgtctctactaaaaatacaaaaaactagccgggcacggtggcaggcgcctgtagtcccagctactcaggaggctgaggcgggaggctgaggcaggagaatggcgcgaacccgggaggcggagcttgcagtgagccgagatcgcgccactgcactccagcctgggcgacagagcgagactccgtctcaaaaaaaaaggaagaaaagaaaagagctggtttggtgacacacacctgtggtcctaactcctggttaggtggctgaggtgggaggatcccttgaggccaggatttccaggctgtagtgagctatgattgcaccactgcactccagcctaggtaacatagcaagactctgtccccatcccaaccctcaacaacaacaacaaatagactgctagcaatagcaatctacaagttcaagaggtcacttagacttatacccgtttttcttggcttgtataacatgttatagaactgaatttgaagatatttgggcctatattattcattttccaaacattatatactctctgttcttctacctgccttctcacttatttactttacctaggcttaagattcctagactctttagagaaagcaaaatgttactatgcttaaaaatatgtaaataagctgaaggctatatgttctggataataatgcatataaaatggttacttaggtaagaatgcatcatccctgtttccaacttgtttgatagaacaagaagtaaaataaatattttacatataggaagtaaactatatgctatctccattcatgaatattcagaactaagatgtaaaggaatattgatattagcatcttgaccctagcaatttgcttaaagtgcctgtgaacagtttcattctgaaggaaattattatatttatataattctaaaacttgacaacaaatttcaataaaataataaaagatactaattgctctcctaagttgatcaaaaggctgaaagttgacattcaatcttctctcagagtccaagcatattttcattccctgggtatttttatttatgaagatacatttcctaaagtttattatatttcaaaacatagtcacacactaatgtaatatgattaagcgagtgcatgtgaaattatcttaactgtgacaagaaactatagctctaaaagctatgatgagtattgatctgaaatgacattattttattaaacattcagaaccttgcataaaactacacatttttttgcaatattggatttaatacaggaacacttttaaaagactgaatttgaaaccaaatatatatatgactgtagatatatatgtatatatatgtgtgtgtgtatatatatgtgtgtgtgtgtatatatatatatatatatatacctccactgaagtctcaaatccctcaatatcatccatgaaggctgaagtcaatttctttcaaactcctgttaaatattgatatttggactcctcttaagaatcacaaatatttttccattcctctgttccatcatggaaatcactatctatggcagctatagtcttacgaaatgtatttcctttttttttttttttttttttgagacagagtctcgctctgtcacccaggctggagtgcagcggcgagatctcggctcactgcaagctccgccttctgggttcacgccattctcctgcttcagcctcccaagtagctgggactacaggcgcctgccactgcgcccagctaattttttttttttttttttttttgtatttttagtagagatggggtttcaccgtgttagccaggatggtctcgatctcctgacctcgtgatccgcccgcctcgccctcccaaagtgctgggattacaggcatgagccactgcgcccagccatgtatttccatagtaataagacttgaaagtcaaaattactccttgatccatgggctgcagaacggatgttgtgttagcagtcatgcaaacaacatttgtctccctgtacatctctatgagagctcctgggtgacttcatgcattgtcaataagcagtaatattctgaaaggaatcttttttctgagcagtatgtatcaacagtggacttaaaatagtaaaccgtgctgtaaacagacgtgctataatccaggctttcttgctgcatttatagagcacaggaagggtagatttactgtcactcttaaaagagtcctaggattttaggaatggcaaacgagcattggctttaacttaaagtcactagctacactggactctaacaagggagtcaacctgtcctttgaagccaggcattgacttctcagctatgaaagcatcttctttagatagcatcttctttcaatacactgctattttgtctacatggaaaatctgtggattataccttagctagattttcttagctagataagaaattatcttacctaaattttctggataacttgctgcagctgctacatcagcactcgctgtttcacctcgcacttctatgttatagacgtggtttctttccttaaacctcatgaaccaatctctgctagctttcaacttttcttctatagcttcttcacctctctccgtcttcatagaactgaagagagttaggactttgctctggattaggctttggcttaagaaaatgtgtctgattttattttctatccagaccactcaaactttcactatatcagtaataaggtagtttcactttcttatcatttgtgtgttcactggagtagcacttttaattttcttcaaaatctcttccttttcatttacaacttgaatgtttggctcaagaggcctacctttcagcctatctcagctttcgacatccatttactaagtttaatcatttctagttcttgattttttttttttttagacggagtcttgctctgtctcctaggctggagtgcagtggtgcgatctcggctcactgcaacctctgcctcccaggttcaagtgattctcctgcctcagcctcccgtgtagctgggactactggtgcccaccaccatgcccagctaatttttgtatctttagtagagacggggtttcaccatgttggccaggctggtctcgaactcctgaccttgtgatccacccacctcggcctcccaaagtgtttggattacaggcgtgagccaccacacccagcctctagctcttgatttaaagtgagagatgtgtaactctttcttttatgtgaacacatagaagccattgtagggttattaattggcataattttaaattattgtttcttagggaatagggtggccaaagagtagggagaaagatgagtgaaaggctggtaacagtcagaacacacagaacatttatcaattaagttggtgtctaatatgagtgcagtttgtggcaattaaaagcaattacaatagtaacatcagtgagcattgattacagatcaccataacagatataataataatgaaaaagtttgaaatattgtgagaattaccaaaatgtggcatagaaacatgagatgagtacgtgctgttggaaaaatggtgcctatggacttgctcaacacagggttgccacaaacctttaacttgtgaaaaatgcaatatctgcaaagcacacaaaagagtggcacaataaaatgaggtacttctgtactcttcatttcactgttgcaagcatgtaggcatcctttttttatttttttccaagacggagtcttgctctgtcacccaggctggagtgcagtggtgcgatctcggctcactgcaacctctgcctcccaggttcaagcaattctccttcctcagcctcccaagtagctgggattacaggtgcacactaccatgcccagcaaatttctgtatttttagtagagacggggtttcaccatgttggccaggctggtctcaaactcctgacctcatgatccacccgccttggcctttgtttcaaataatttgtataagaaaatggtctaaacagctgaactctctcctacccaacaatctgccttaaacagcaaatttctagacatccaaaaatgatagtctcacttaaaaaaattctgtaagtggaggtaatgagactccgaaggggaacagataaattaagtaatatatcggaaaccacaaagagagtaaatggcagagttgaagttcagacacagctagtttgtttctggggaccaatctctaagagaacaggacactagggtcatctagctatatgatttctctatacatgagttcaggaattgcaatgtgctcattaacatttctcacataatgaaatattaaataagaatggttatacatcagtgagaacacatggacacaggaaggggaaccacatacactggagcctggcaggggagtggggtggggagggagagcattaggaagaatagctaatgcatgctgggcttaatacctaggtgatgggttgataggtgcagcaaaccaccatggcacacatttacctatgtaacaaacctgcacatcctgcacatgcaaatcagaactaaaaagaaaaattagaaaagaaaaaaagaatggttatacatgtctaatgaatttcccctttctttctaaaatctagcaagtcacaaagcaagcacagatgaaaggtacttttctctgtctgagtagcagctcctgtatcagcattccccttcatcagttcaaactcataggattccatttaatccaaatccatccacaaaacaaacaaacaaacaaaaaaaaagatttagagtattctctacctatttaaaacctcttgctttaaaaagaaacaaaaaagacaaaatctggtcaaatttaccctatgcaagaaagtgttcacaaacctcaacatcacatgactttgtaagataaatcaagttataatacttccaaatcttggccaactaaacctgctaaaaatttaggaattagatataactcttagcccagaaacaatattctttaagacccaatttgatcccaaattccttcttctggtaaaagaattggtcaacaaaattaaattataagaattgggtccacagaaaacatcaggccaatcaaaagttcatataattacaaccagaaagtaaataatccaaccaaataaaatcacaaatttcacagcaagctaatcaaagaaaaaaaaatttaaataatactgagtcaagaaagcctatccatccaaaatctctgcctaaaatgtatagacaaatgagaattaaataggcaatctatcaaccctggatctggacaactaattttctaacaaaaattcccctacacaacaaagaagctaccaaatcataacttatagaaacacaacagctaagaaaaaatctaccccttatccagtccaaatagccacaatgacgcaaaagaaaaaaaattaacccccactttagaaccaatatttaacagagctccaaacaacacctattacgctcagctttaactagtaagagaaatggtctatgccaaactatgacacaagaccttcagaaaatacctgtataatcaaaatttcacaaaaatatgatcaagaagcaatgaatcagtgaaataaaaattcccttagaaaagcaaactaaccagagaaaatactactttaacacaactgaatcaaaacaagctagttctcaaatgcagagacaaagacaaaaatacagaagaaatctaaacagcataaacagccattgagtgagcagagacctatcctatgtaagaggaggcatcatcaacctcatcaaaaacttcttggttaaaaaaaaaatctccagcacagccaaggagtaggcaataccaaaattctaaggactcagtaacatacaagagatctagtgtgagcaaataccatccaagtaaaactggtaaaaagttgccaaagaaatctaaaactactt

SEQ ID NO: 682 - DNA, 20845 bp, Homo sapiens
aaaaacttgaataaaaacaggacattctgagatgactgaagtattctgactttggccaccttcctgcatgcattatgggtggacataatttttgataagccaataaaacatattgacatccgttaaatgtcatgtcttaatgacttcatcataaagctgattttcaacattttcacatcctcaaaatacaagagaaaaacattttattcaggcttttattatacaaatagtaactttttacaagataaattagaaaaacagagctttccaataatataagcagtttaaatagaaatgagcctttttccagttgatatgataatgatgattaataattactgaacattggaaatgtgaagggtagcatgtcctttgcatatacatatttgtagatggggtaagtcatcatattcagcctgttaccttttgagtgttttctctgttataggtaattttccaaatgcattacatacattatctcttctttaatcctcaaagcaagtctcactatttttaatctcactaaaatacaaataaatttagattcaaattatgcatgtcttagctggattattgctaaattgaataatgtaggagattaacattaattatagccctttgagaggggagtgtttcttcctaatatagtattttcatcattttcatcattttactttagccagttgtggaaagggagcttatcactgcgattgggttaagagaacaggaaaagaatagatatttactatgaagatttttcattacataatatttagatcaacatcggtatatctttaggaaaaggtactttcagctaattttttaattgtctcaacaataaaaatgtgtgaaatatttttccatactaaggatttgttttcttgacaataaaaaatcaaatcctgaacttccacataacctgactagtccttggattggcagcccttgggtcaaacaccctgcataacaacttgaaccatcactagctagagaagacaaatgcaaggctggtcccacagaagtgccttggaattttttgtttgtttcattggtgatatgaataaaacttttaccggcatgttaagggcaaaagccaggttgaagagcaaatgggaagtgagaagtggggttggcaaatttagaatactctttcatagagctttgctttgcaggaaagaggtgaaaaggaggtcacaacaacaagggtattggtggttgaaactgaatcttttataaacagggaaatatcaatttatatttatttcccaaatgatgtcttcgacctctctgtacgtgttaggtgaaagcggcaagattagaatcaagaggtcaaatcaacgggccctacagtaatttgggtaaaagtaaatgacagatgagaatgaaagcaagaaagatgataagaagtggttagatttagaattcagggagtgggatgaagagctgataggatagggagaaaaaaaattgagttgaacataaatgatagtgtttttctgaagaaaatgagctaattaaatggcagatattacttgcagaaagtaaaagagaagactgacagagccaggtccctcagaaaacaattataaagaaaaagaaactgtctagctatcaatgactccatggttgtgtggccagtaaatcagggaagttcgtttctaattgcctgaaatatcttggtgaagcaggagaaaagccagtttggtgggggtagatgagagctcaggatgaagtggagaatgtttataaaattggcatcaacttggaaaattacaggcctctggggaagtgggaagagataatctaaggtaagatactcaaaaaaggatttcaggcagcactgaaggacgctaactttctgatggtacagtgcttgtgacatcctctagcattgttaagaacctggaactaggaatccaggagaaagatggtttaccgtaatactaaagtttaggattagcaagggtaatggccagacaaataggtgaagggactgagaaccacaagaagtgaatgtagttttgtgccctatataaaccatctgctccaagcaacctggagttcttgccgtcagtagagtggaacttcattcttaccccagagcatttgcatattttccttctatttggcatgctccctccttattttgtattctttaagcctcttttcaataactccttatcacagagacaatcctttatcattttcctatccagaactgatctctttaaatccctaatgtatttgttccttgcactacttttcagctatttttagatttttaatggagatggggtcttattatgttgtccaggttggtcttgaactgctggcctaaagctatctacctacctcagcctcccaaagtgctgggattacaggcatgagccaccatatccagcctcagctattttcatttctaaaaattgtactctatgtaaaccagacctgagataagcaccaccctaggcactttacaggtgatatttcacaatagatgtgacaacaaccgcaggagatgggtacttttatgaacatcattttcctgataagaaaaagagactcaaaaaggattctatactcaccctatctctatgtgccagaaggagagctcaaacactggcatgaaatcccagacactcattccattcatttcacttccctttagatcacatttatccccccctgtattgtaattactcagcctgtggattcatagaagacatgtttgtacccctggcaaactgccaggttgacattcatgacatgaatgaaccagctccttcattagctcattgcacaaaatagttgctcacatgtgtttcacaattaattaatgttcaaagcccagaacaaccctgaactcttgaattagacataaaaagacgtgtctttcccatgctgcaaaggcatttatttccatttagaatttggaatgacagacttcactacaggccaaggataagatttttgctcattatctattttttccagtcaatactatccaagctttcattgagagcctaggtattcagagggcaaaagagaaacatttttctttgatacagaagttcatacatcataacttagatacatttaacaattttctattgctcaataacaaattaccactaattagtagcctttaaaaactcattattatctcagtttctttggccataactctgagcttggcttaggtggcttctctgctcagagtctcacaggctgaaaaggtgtgtccattgctgtattttttttttctgcacctcagtgtccttttttaagcttgcatggttgttggcaggattcagtcccttggttgttggactgaagcccctattttttttgctgcctatgagccaggggccactctcagctcctatagccagtctaccatgtacttccacatggccctcgccacaacacggcatcttgattcaaagcccagaggaaagcatttgctgcagcttcaaatctctctgattccttctcacattgtagaacctgttttaaaagggctcacctgataaggtcaggccagcatgtgccagcagggagtagaaatcttgaggccatctcagagttctgcttaccatagaaaccattcacccttatatttaactgtgaaatatctgatttaaaattatttacttctttgtttccacagcctggtgagagtcaaagaggccccaggggaccatatccacctggaccactggctcctcctcctccaccatgttttccttttggaacaggatttgttccaccaccccatcctccaccctatggtccagggagatttccaccacccctttctccaccctatggtccagggagaatcccaccatcccctcctccaccctatggtccagggagaattcaatcacactctcttcctcctccttatggcccaggttatccacagccaccttcccaaccaagaccctatccacctggacctccatttttccctgtaaattctccaactgatcctgccctccctactcctgcaccctaaatacagacaactgcaacaggtgccaccacccacaaaagacaacactaccctcgtaactactgcttctactacccaaaaataagaatttcaacactacttccaagagacttttagataaaatcacttccatttttggatgagaataaagatttccaaagcactgagcttttgggagaaatatcttagaaattgtgaaacgatccccatgaacctttatatcagtaggggaaaataaagaattgagcaacaatatgaagtatccactgttatcagagccaatagtttacaccccagttatgtcacctaaatgaatattagtgctaacagagcctggccttgtcccatgaagccaaaaaagtaaattaaggaaaaatgcaatgagacacttggacttgaaccttagagttacaaagttagaagagtaggcaacaagatgccctcttcagtatggcaacccatcatacaattacaaagcccaaaataagtgttaatagatactaaaatgaaagaatcttagcccttaccatagcttgccccataaaaattcctgagtaccatctgatcactgcttataaatagttgcagagaagaaacaccattctaacaaacctaaatatctgagatgtgaatcacaagtcttagagtttgatatgaaaaaatcattttctaagctaagatagagataggaaatggtttcagatagcaataagaagaagctgatggctgagatttccaagtttctactgcatctatttgttgatgtttgaatcagaagtattatgatacgactatttaggaaatggcctcatgatgtcatgagagctttatctttccattccatgtttgacttttttcttcaggacacttaactttccacattgccatcaaacacttataaattaaaacttcttaagacacctaaagtaagcacacaatttttatttgtgtttaatgctctccttttttttttctttccatggaaagggtctcactcccatcacctaggctgaagtacaatgacgcaatcacaactcactgtagccatgaattcctgagctcaggaaattccacctcagcttcctaactgggattacaggtgcatgccaccactcctggctaattctgttgtatttttagcagagatggggttttgctatgttgcctaggcttctctttcacttttgagaacctaccaggatacagggactgttttagtagcaaaataacagcaatattgaaggtagtcaaagtaactgtcttcatggagcttatatctagtgagatattttttaaaaagtaaacacatgtcaataaaatgtaagatgtgagagtgttttgaaaagtaatgaacaatgcatagggagacactaagtagtggtgactggctgttttatataagataataatggagaagctctctgatgaagtgatatttgaggaatgacttgaagaatattaagaagcaaggtactaaatgatctagagaaaaagcaaccatgtaaagatctgaagcagcaataaattttgtgtatgagaagagtcaacaaaagttaatgtggttcacactcagaaaagaggagagtggaaggagatgatatgaagaaggcagagaaaaacacatcataaagggatttagattttgaactttattctacatgttatgggaagtcattgtagctttaaatgaagaaataatattatgtgattaacattttcaaaacttcatcactctggctgctctatggatagaaaacttagaagagcaagagtgcttaatacctaggtgataggttgatagatgcagcaaacaacatggcacacatttacttatgtaacaaacctgcacatccttcacatgtatcctggaacttcaaataaaataaaaagagcaagagtggtggctatttcaggagtcctgatgagagaagaggtggtttagactacggaaagatcagcagagatgaagcgaagtggtcagccacaatatacagttgaaaaaatatccagaaatctttgatgaagtacggaatcttgggttctaggaaaaatacgtaatctagaagcaactctgataattttggcctaaacaactgtgtcaataatggtgtcatttagtaagttaaaaaatgggaaaagatcagggtgtaagggcttggaatatcataaattctgcattggccatgttaaggttgagttatccgtttaacttctgcattattgtattgctgtcataacatgttatcaccaaattaaaagcacaaaataacaaattatctcactaatctatagaaagaattttgttaatagtatagctcaaatagttcctctgcttagagtctggcaaggctacaatcaaggtattaatagggctgcatgcctttttgcagactccagggaaaaatctgctttgaggctcttttatctctcctatatatctcttcttcctgactcttgtttggctgcatctctctgaatctagccagaaaaaaaaaattcacctgtttttaagataaatttcctttccttgattatttaataaaagatagactagagtagatatgaagtttattgctttgttgtaaaaattgggggcaattcaattgctggtaatgacaatgtctaagggattactgtgaaaaaggttgggataaaatacaacaatgctggcttttcaaatccaaatgttggaagtaagcaggtcaaggaattaggaggccatgggttggatgaatcatttatagggatgttgaagtcaccaaatgtgacaaataaagggagaagacagtgaccaaagtggtagtcttttaaaaatgtcaagtagtgatcgggcaggaagaaataacttcaatacagaagagtagtggggaggcatagcttttttgaaggttcttcaaagttggaatgatggaaaagagatgaggtttagaaatagcaatgaaggcaaggtcatctacctgaacttggtgttgctacatccatgttatttgtaactggaagtgatggataacatcacagtagaatataactctcaaaaggctttcattatgacataaacattacaaagcagtgctatcagtaaatgaaataaggagtacctaaacagaaacaagttgctgtgaattactcaacaaggtcctgtgtacttagctgacatgtggtgatggggtgaaaagaatgagtatgtgtgattcttcttaatattgttatttcaccctgattcaaggtacaattttatttttatttgcaaaatatctgagcctctaatttgcatatttataaagatgagtgatctatacttttgctcccaagccctgcagaacagagtatggagaaaacacaaccacctccaccaagtattctagtacacatagtgtacttgagatacagacaaggtttgagttttgcaatgtattactgcaaacacacagagaagaaactgagaatatagaggctcctgctgatgaattttcatgagtttgagagagcagtgttgatgtttgtagatgggggaagaaagagattatacagacctctgaggatgacggtctgaatacaggtggatgaacttagagacatgaaatcttagaggaaaaagatgaagaagtgtaagacacaagattagtcctgatggcctcttagcgaaaagtgggtaatacattttcattacatcttctctctcgggatcattctgtcaggataagagggtcttaacaaaagcacccaaagctcaaaaaccctctatttcaatgttttcttagtttgtttaacattatttactgacctccatgtgccatgaaccattatagttacccgaaataactaagtgataaaactaaaatctttgccctcctggagcttaaagaatatcaagggggagaaggttatgttttttctgtcaatcctgtgaaaaacctttatctattcaagttcaccttgatattatttgattggcaaatgctgaaatacctatatttttgctttaacagttttggtgactgcagagaaagaaatatgtgattatcattccatctttagacaaacctacttctcaaaggtgtcttgaaattcatgaaaaatgtacataattaaaactataatatcaccaaaaagaggatacaaggaacaccaatatataaccagccggaaaaaaaaattattttttaaataatgcataattctaagtgtctgcatttcccttggaatgcatcacaagtttcacataagtcatgtgtaaatatcacaacaatgagagctgaatccctttaaaataaggcaagtgcatgcctgaagcactttcaacctctgactaacatgagagatcaggaaacaaggagtagttgtaaaaggtcaatagatagcaggtttattggaaggggtgaattattaaagtaagcaaaaaaaaatacaaatagggtagcagagggtttaatgtttgaaactgagagtttggaggccatgcagaaccattatctggaatttgtttctctcccaaatgtcctctctaggtacttttaattaaatatgcacatacatacacatctataaccaccacctcacctcattacttgcaggcattttaaccagcaaaggtagtatttctcccatctcattgtaagcacatatactgccccaaattttccccttacaagaaagcaccatcaaaaatcacctcatcttacagtgtttggcaaacacagttcctgcaccaacatctttctgttgcttttccagtccctttgtaaaactgctaaacaattgtttcaagtccattctaatccttcattcaatttgtatgcgctatcaactaaatatcagaactttacagtcaattttgcatataaagttaaacacacacaatcactaccctcaaattgttcattaatcctttctggtctggcagcctgtctggacacactacatatttctgccatttactgcagtatcctattttatccacccatctcctctacaccatgagcaatcaaacagcaaaagtatagatcacttgtttttataaatatgcaaattagagactccgatattttgcaaataaaaattaaattaaatcttgaaccaggatgaaataacaatgtaaagaagacatcatgtatacccattcctctcactctaccaccacatgtcagctaagtacacaggaccttgctgagtaattcgcaaggataaaaaatgatctcacctaccttcctattttgtacttcttatttcatttactgatagcacggctttgtaatgtttatgtcataatggcagccttctgagggctatgttctaccgtgatgtcatccatcactgccaattacaaatactatggatgtagcaataccaagaaggatgttgcttcagaatgtctcctatgcacccaagaatcccaagttgcagatgaagcatcatatcattaaatattgggcttaagaagcctacaaatatccagaaaattctgtatgaatatagatcaagtgaacccttaaggaaatatttattctaaagggtcactttgaagaaatatccaatctatctgagtattcctaaactgagaaaagtagtttaactatatagaaatgtcaattgtagcaaaaactctataatttcaaaggggtatctatctccctattctttctggacatacagccagactacatttctcagccttccttgcaattaggcatcgccatgtgctgaatttcagccaatgaaaggagagaagaacgtaataggagttacttctgaaaccgtgccccaaagagttaaagaaaccagtaactaacagaaattcttgagtttgctggatggtagatgagaaaagaaacaagttgctgaaacactgaaactccctctgcttaagagataaaagaactggaagaaatcggctggaaccaatatggccaaatggagtttacacagaacgagcttgctgaggtcacaacctgagtttccactgcgtgttgcatagtaactccccacaaatttgcatatgggactcatgaggaggcatgaagagataactgtgtatgcccaatgactttccagatctcccctttccttccacaaatcactgctattcccaaaatccacccactaaaccttttttttaattttcaaaaaaattgtccataagttattggggtacaggtggtgtttggttacatgagtaagttctttagtggtgatttgtgatattttggtgcacccatcacccgagcagtatacactgaactctatttgcagtcttttatcgctcgccccctcccatccttcccctcaagtccccaaagtccattgtatcattcttatgcctttgcatcttcacagcttagttcccacatatcaataagaatacatgatgtttgggttttcattcctgagttacctcacttagaataatactctccaatctcatccaggttgctgcaaatgctgttaattcattcctttttatggctgagtagtattctatcatataaatataccagagtttctttatctactcatgattgatggacatttgggttggttccatgattttgaaattgtgaattgtgctgctataaacatgcgtgtgcaagtatctttttcatataatgactccttttcctctgggtagatacccagtagtgggattgctggatcagacagtagttctacttttagttatttaaggaatctccacactgttttccatagtggttgtactcgtttacattcccaccagcagtgtagaagtgtttcctgttcaccacatctatgccaacatctactgttttttaattttttgattatggccattcttgcaggagtaaggtggtatcacattatggttttgatttgcatttccctgatcattagtgatgttgagcattttgtcatatgtttgctggccatttgaatactttcttttgataattatctattcatgtccttagccctctttttgatgggatttttttttcttactgatttatttgagttcattgtagattctggatattagtcctttttcagatgtatagattgggaagatattctcccagtctgtgggttgtctgtttgctctgctgactgttccttttgttacgcaaaactctttagtttaattaagtcctaactatttatcttttttttattattgcatttcgttttgcgttcttggtcatgaaatccttgcctaagccaatgtctagaagggtttttccaatgtaatcttctagaatctttatagtttcaggttttaaatttaagtccttaatccatcttgagttgatttttgtttaaggtgagagatgaggatccagtttcattgtcctacatgtggctagcatcatttgttgaaaaagatgtcctttccccactttatgtttttgtttgctttcttgaatatcagttggctgtaagtatttgggtttatttctgggttctctattctgttcccttggtatatgtgcctatttttataccagtaccatgctgttttggtgactatggccttatagtatagtttgaaattaagtagtgtgatgcctccagatttgttctttttggttagtcttactttggctatgcgggttcttttttggttccatatgaattttagaattgtgttttctaattttgtgaagaatgctggtggtattttgatgcagattgtgctgaatttgtagattgcttttggcagtatggtcattttgcaatattaattctacccatccctgagcatgggatgagtttccatttgtttgtgtcacctatagtttctttcagtagtgttttgtagttttccctgtagaggtcttttggctgcttggttagatatattcctaaggttttttttttttttttttggttttttttttttttttttggcagctattgtaaaaaaggttgaattcttgatttgattctccacttggttgctgttggtgtatagaagagttactgattcgtgtacattaaccttgtatccagaaactttgctgaattattttatcagtgctaggagctttctggaggagtccttagggtttttaaggtaaacaatcatatcttcagcaaacagtgatagtttgacttcctctttaccaatttggatgtcctttatttctttcttttgtctcattgctctggctagggcttccaatactgtgttgaagaggagtggtgagagtgggcatccttgttttgttccacttctcagaagaaatgctttcaacttttccccattcagtattatgttggctgtgggtgtgtcacagatggcttttattacattgagctatgtcctgtgtatgccgattttgctgagagttttaatcataaagggatgctgtattttgttgaatgctttttctgcatctactgatatgatcatgtgatttttgtttttaattctgtttatgtggtatatcacatttatttaaagatgttctttgaaaccaatgagaacaaagacacaacatacaagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaacctagcagaaagcaagaaataactaagatcagagcagaactgaaggaaatagagacacaaaaaacccttcaaaaaatcaatgaatccaggagctggttttttgaaagatcaacaaaattgatagaccgctagcaagactaataaagaagaaaagagagaagaatcaaatagacacaataaaagatgataaacaggatatcaccaccgatcccacagaaatacaaactaccatcagagaatattataaacacctctaaacaaataaactagaaaatctagaagaaatggacaaattcctcgacacatacacactcccaagactaaaccaggaagaagttgaatctctgaatagaccaataacaggctctgaaattgaggcaataattaatagattaccaacccaaaaaagtccaggaccagatggattcacagccgaactctaccagaggtacaaggaggagctggcaccattccttctgaaactattccaatcaatagaaaaagagggaatcctccctaactcattttatgaggccagcatcatcctgataccaaagcctggcagatatacaacaaaaaaagacaattttagaccaatatccttgatgaacattgatgcaaaaatcctcaataaaatactggcaaaccgaatccagcagcacatcaaaaagcatatccaccatgatcaagtgggcttcatcgctgggatgcatggctggttcaacatatgaaaatcaataaacgtaatctggcatataaacagaaccaaagacaaaaaccacatgattatctcaacagatgcagaaaaggcctttgacaaaattcaacagcctgtcatgctaaaaactctcaataaatttggtattgatgggacgtatctcaaaataataagagctatctatgacaaacccacagccaatatcatactgaatggacaaaaactggaagcattccctttgaaaactggcacaagacagggatgccctcactcaccactcctattcaacatagtgttggaagttctggccaggacaatcaggcaggagaaggaaataaagggtattcaattaggaaaagagaaagtcaaattgtccctgtttgcagatgatatgattgtatatctagaaaaactcatcatctcagcccaaaatctccttaagctgataagcaacttcagcaaagtctcaggatacaaaatcaatgtacaaaaatcacaagcattcttatacacaaataacagacaaacagagagccaaatcatgagtgaactcccattcacaattgcttcaaagagaataaaatacctagaatccaacttacaagggatgtgaaggcctcttcaaggagaactacaaaccactgctcaatgaaataaaagaggatacaaacaaatggaataacattccatgctcataggtagaaagaatcaatatcgtgaaaatgaccatactgcccaaggtcatttatagattcaatgccatccccatcaagctaccaatgactgtcttcacagaattggaaaaaactactttaaggttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaatattgccacatatctacaaccatctgatctttgacaaacctgacaaaaacaagcaatggggaaaggattctctatttaataaatggtgctggggaaactggctagccatatgtagaaagctgaaactggatcccttccttacactttatacaaaaattaattcaagatggattaaagacttacatattagacctaaaaccataaaatacctagaagaaaacctaggcaatatcattcaggacataggcatgggcaaggacttcatgtctaaaacaccaaaagcaatggcaacaaaagacaaaattgacaaatgggatctaattaaactcaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagttggcgaaggatatgaacagacacttctcaaaagaagacatttatgcagccaaaaaacacatgaaaaaatgctcatcatcactggccatcagagaaaggcaaatcaaaaccacaatgagataccatgtcacaccagttagaatggcaatcattacaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccagcccattactgggtatatacccaaaggattataaatcatgctgctataaagacatatgcacacgtatgtttattgcagcactattcacaatagcaaagacttggagccaacccaaatgtccaacaatgatagactggattaagaaaatgtggcacatatacaccatggaacactatgcagtcataaaaaatgatgagttcatgtcctttgtagggacatggatgaagctggaaaccatcattctcagcaaactatcacaaggacaaaaaaccaaacacttcatgttctcactcacaggtgggaattgaacaatgagaacacatagacacaggaaggggaacatcacacaccggggactgttgtggggtgggggaaggggggagggatagtattaggaggtatacctaatgctaaatgacaagttaatgggtacagcacaccaacatggcacatgtatacatatgtaacaaacctgcatgttatgcacatgtaccctaaaacttaaagtataataacaatttaaaaaaaaaaaagagctaatgacaatcccaccaccctttgctgactctcttttcggactcagcccgcctgcacccaggtgaaataaacagccctgttgctcacacaaagcctgtttgttggactctcttcacacggaagcgcgtgacatttcttgtataatttttataccaaataaaccaaattatgtcatttttggactttagggaatctgatatcgtaaaagattaattaggtcagaaaaagacataatttataatttgattttggaatgtttgtcaaatatcaaaagtttaaaacacctgaaatcacagttcattgtaaaataagtcattcgttttaccaaagtcaattctggaactgaggtcttttcatttccatttcagggaacaatacactgttttactccaaaatataaagctgtaatttaaggcatttgtactaacttttaggttagaatatgtgtatctttcattttttaaacatttttaatccttcattattttcaatagatttcatttttagagtccctcatcatttttaagtaacaaattcttaccaatagactatatataaattttagtaataactttattatacaagcccaacatgatcttagtattaattctgcccctctctgatgttctttcttcatttaaaacactaagacattggccaggcacagtggctcatgcctgtaatcccagcactttgggaagctgaggtgggtggataactgaaggtcaggagttcgagcctggccaacatggtgaaacccggtctctactaaaaaaaaaaaatacaaaaataggccaggcatggtggctcgtgactgtaatcccagcagctcaggaggctgaggcaggagaatagcttgaaccttggaggcagatgttggagtgagccgagatcatgccactgcactccagcttgggtgacagaatgagacttcttctcaaaaataaataaataaataaataagacattaacatcttcctatgtcttgcagttatcttgaatattcaatgagaaaataaatatagcatgatttactatacaataaatgtattacactaatggtttaaaatttttaaagtacttgatgtcatttacagagaaaacatgtgtatgactagatttgttttggtaaaaataatattacagcaaagaaaatatatttttagaattaagatgaatccaggaatattccccaaaaagattttgaaaggggaactgaatttatgtggttacatggttgaggttatcaatctagcaaaattctgattaaagggcaattgtatctttgtttacattcacagtctggggacatcccggttatactacaaagaccaatttggcatttactatagaaaaatagaccttctgcttaaaactattgggaaattttcccatgactctcagtggaaagcaaagctacttttctcaagaaattaccatgattatattttatggacatcgtaaatgttttacctgatttctttctttttcaactttggctacttggaatctcagggcaaatttgttgtcaacttccagaaagtttacagacctatgtgatgtgggtttcttgaagcatccatgctgcacaagttagagatattaacttttcttcagtctacaagttctattgttaattacatttcatcatgctagacttcaatccaagagaacatattttctctcagagctcaatggcattattgatatcctacacaacaatatttccacagaaattttcaaggtaatctgtaagttctaaagcatgataagtatttcaggtggcattatcccagaaacaatatcacttccttctggataatcaagaagaagcacatacttttcataggtccaaagaaactatgatgattgctatatttcagtggaaatgagtataatacaacaggaaatcagacttcaaatatgttgctgcatgactgaatttaattctgctaatctacctctattaagaaaatattttccatctgtcacgtaaatctctgcactaacaataatttttctctactgtcacttttttaatttcctgtggccagagacattagctcttttatatattgttctagtaagtattgagtcaggatcttctaaagccataagttaattaaagattaatttgagtgactgttcctgtttcttaacagatgtgtgcttccatttatttgtgttcctcagattctttctggtcacaaaccactcagaaattgtctttcggttttgccagcgttcatcctaaatccctcagagccaatgatccattacaatgtagatcccactttgacttcagacatttggctggtgaatatgttggcatcaaaacaagaaagaagagatattcagcttttgacaaactgaattatcatcaaagaaagaagtggaaatttctatgttaattaggaatagaaccatcttcactgatgttggggcatgtaatcattcagcaacatattaagggctaagattagcaaaccaggagtatattgtattacacttaattaagtcatcagaattttttaaaggcagtgaaactccaacaaagtaaatgaaattaagaagagtcattcaaaactaacatcaactctggaagtgcagcttctttattgctatcccacctcacaaaggatttttaaaacactaagcacttagatatgctgtaaattcagcaacttgcactatgtcttgtacccagcagatattcaataaatgtaggagggagggagggaaggaaggaaggagggcaggagggaaggagggaaggagagaggggagggaggggagggaggggaggggaggggagaaaggaaggttggttgtaaacttcatgacctaaaaattataaatatacacatttttcaaatgaagaaattgaaacacaatgagataaaatagcttgtctcatataacccagcaaagaattgttggtatttggctttgaagtagaattacctgactattaagttcacttgattcatctctacagtgtactgtaacataaagttagttaagtgtatggtgattattaagatttggggagcaacatggaatgctggttaaaaactcactcaggcccctgtagggagacttaggtcttcactcagtgggaagacttaggtcaagccccacttagctagttagcatctatgtcatctatgtgtacaacagagataacaatagaactcattttatcctgccacgtggaatatgctaaaggtttaataagtaatagctgttattattaaataataatgtgtcaaaactacagattataggatcatctagcttaggaaaaattatgctcaaagcctagatttatcaaaaaaacaaggctgtaattttccattagacatccacttcaaagtcaagatatccgtataattttgccataatcaaaaattttgcttgtcattatatttttatttaattaaatgtctcaagttaataatggcaaggaccacatgatttttaaaacacagttgttctcatttagttcttcactggcaaaaggaacttcctaaaaaatgcatatataaggtcttgtaaatagtctactaacttaagataatcacaaagaaatgaaatatagttaagactgagaaactgcatgaaccttctgactattatccctcttccaccactagatttttctttcctgcttttttgaaacttagatccaaatcttaatagcagcactcattttcatcatccttcagaaacatctactcaatgaagacaactgtgaaaaaccatacataggataagatatatacaaactttcaagcacaaaacaataatacaatttcattatttcaaccaaaaaatagaaacatgaaacccacaacatatagcaaagtgatcaaaacagtcaagtgaaattttagatattctttacattactggccatgcatcgtacctgcgtgcatgtgtgtgtgtgtggtatttagcaatatttatttaattaggcacttttaattttaattatcatttttgttcccctaggttctcctgatcatgttagaattcagtttaaaaatatttgtatttcgcacatatggaggcctttgaaataaaatagaaaatatgatgagactagcaaataacaaaagatggcccattaaatcacttggaacagaaaaaactcgtgccagcttttcctttgaaataaagaggaaatggtgcaccacaggccccagattgtttttctgaggtgataggatattatgatttgttgtatctgtttcctcaggaaacagcaaatgttgaacaggtcaatgcttttcaggaatgaaaaaaaatccagaaaaagactgccaaattggcaagaacaactttcctatctttgaagagcatcaactcggaagttattttatttccgaatagcctttctcttattgccaacagaaatccattacaatatataagagctaagatttcttgtcccttttcacctttatttgccgtctttcaactggcaagagtcattttgaccagcagattaatcaactgtaagacagatcctcacacaaaggtaggtacttggaaatataaactgaatatttttactttgaatattgaaatttttctcaaagataacattttcaacgataacattttatgggcttttcatagaacattcattatcagcaaaaacataagtagcttacatgaaattgtaagtcattaaatgcaataaattttgaaaaattctggtttttacaggtcagagtaaaacattcatgttgggcatttgggccaatcggtccatccaagtacacaattgacttttcctcctgatgtaccttaaagttcttgaaacttcataaggatagaatagtctcaggtgtactctaaaagacagaattgctctacagaatatttttattattggtttttcttttgtttttcaaacttaatttaagaatggatataggaaaagtactagttaaaggaatagccacacccacatatatataattgaatatccagtgaaattttgtccataggattctttcaagacttgcattgctcagaccacacactcaacctatgtgcagagttgactaacaggaagccaatttgcaccatggtgtatggagttgctttcccaaaaatcaagctatcatgtacttgaaat

SEQ ID NO: 683 - DNA, 63838 bp, Homo sapiens
attccccggcccagaaaacttagttctgcttttttttttttttttttctgttaggttactactcagaagcaagaggcaagaggcaagaaatgcatgattgaatacttgctcgatttaggaggggagagtaaaagaaacaggttgaattttaaaaatgttattgagttggctgggcatggtggctcacatctgtaatccaatcactttgggaggctgaggagggtgggtcacctgaaagtcaggagttcgagaccagcctggccaacatggtgaaaccctgtctctacttaaaatataaaaaattagctcagcgtggtggtgggtgcctgtaagcccagctacttgggagactgaggcaggagaatcacttgaacccaggagcagaggttgcagtgagccgagattgcaccattgcacaccagcctgtgcaacaagagtgaaacttcgtctcaaagaaaaatgttagtgagtcacagttgtgtcagagttctcaaaatgcagaagccagctttctaatgctgtagcctctgtccaggacagatatataccatgcagatgagagaggacccagtgtagttcttaaaaatttcagtgcatgagactgagcaggcaaccaccacttctcaccatttcactcactggccaatttcttggttttgttgctcttgtgacttcttgttagtgatacaggcatttgcgtatacacaccgttttaagaattcctggcacaaagagatgcttaagaaatattacttgatgtttgatatagtttggctgtgtccccagccaaatctcatcttgaattgtagttctcataatccccatgtgtcatgggagggacccagtgggaggtaattgaatcatgggggtggttttccctgtgttgttcttgtgatggtgagtgagttatcatgagagttgatggttttagaagcatctggcattacccctgctggctctcattctctctcttgctgccctgtgaagaggtgccttctgccatgactgtaagtttcctgaggcctccccagccacatgcaattgtgagtcagttaaacctctttttaaataaattactcagtcttggatgtttcttcatagtaaattggtaccaggagtggggtgctactataaggataccccaaaatgtggacacaaatttggaactgggtaacaggcagaggttggaaaagtttggaggactcagaagacaggaaaatgtcagaaagtttggaaatttctagagattggagggcccagaagacaggaaggtgtgggaaagtttggaacttcctagagacttgttgaatggctttgactaaaatgctgatagtgatttggacaatgaagtccaggctgaggtggtctcagatggagatgagcaactcgttgggaactggagcgaaggtgactcttgttatgctttagcaaagagacttgcagcactgtgcctctgcttgagatctgtgtatctttgaacttgagagagatgatttagaatatctggcagcaaaaatttctaagtggcaaagcattcaagaggaagcagagcataaaagttagaaaaacttgcagcctgacaatgcaatagaaaagaaaaacccattttctggagagaaattcaagctggctacagaaattggcataagtaatgagaagccaaatgttaatcaccaagacaatggggaaaatgtctccagggcatgtcagagactttcacagcagcccctcctaacacaggcccagagacctagaagagaaaaatggtttcatggtctgggtccagggctcccctgctctgtgcagcctcaggtcatggtaccctgcatcccagccactccagctccagttgtggctaaaagggtccaaggttctgttcaggttattgcttcagagggtgcaagccataagtcttggcaacttccacgtggtgttgagcctgtgggtgcacagaagtcaagaattgattggggtttgggaacctctgcctagatttcagaggatgtgtggaaatgcctgattgtccaggcagaagtttgctgcaggggcagaggcctcattgagaacctctggtagggcagtgtagaagggaaatatgtggtgggtgcccccacacagagttcccactggggcactgcctagtagagctgtaagaagtgggccaccatcctctagaccccagaatggtagatccacaccgacagcttgtactgtgcacctggaaaagtcgcagacactcaatgccagcctgtgaaagaagccaggttgggggatgttccctgcaaagccacaggtgtggagcttcccaaggccatgggagcccacctcttgcaacagcatgacctggatgtaggacatggagtcaaaatagatcattttggaacttcaatatttaatgactgccctgctggatttcagacttgcatgggcctgtagccccttcgttttaaccaaatttttcccatttggaacaggtgtattcacccaatgcttataattgtatctaggaagtaactaacttacttttgattttacaggctcataggtggaagaacctggtcttgtctcagatgagcctttggacttggacttttgggttaatgctagaataagttaagacattgggggacagttggaagggcatgattgtgttttgaaatgtgaggacatgaaatttgggaagggccaggaatgtaatgatgtggtttgcctttgtcctcacccaaatttcatcttgaattgtagttcccataatccctacatgtcacgggagggactaggtgggaggtaattgaatcatgggggcagtctcccccaagctgttctcatgatggtgagtgagttctcatgatatctgatggttttatgtgtctggcatttcccctgctgactctcattctctctcttgccaccctgggaagagatgccttctgccaggattgtaagtttcctgaggcctccccagccatgcagaactgtgagttaattaaacctcttttctttgtaaattacctagactcgggtatttcttcatggcagtgtgagaacgaactaatacaatgttaattgttaatactttctttttctgacttttaacatttttaaatgctattttattattattttttggccactggattcccattccacttgaattgaataacaaatagtagaaattaaagttaaaaagtatgttgaatattgaataggaattttaattttggaaatattcatgtctacatttaaataagaagtggaagacagtaaaaaatgaaacaaatgcagtccctgtccttggcgggactgaaggagtttctgaaaggaaacttttagtggtgcctttaagcacagaactacagcttataaaagtccatggacatcaaaagtatgcaaagcttggtggaatttttgtgtgcagtttttcctagagagaacagaaactatggaacacagtcataaggcagaaaatgagagcaagagtgattatgtcaggcagcttgctctggcagagaattaaagccggatgctctttctaccatggcttgtttggctcccaagaactgtggcttctacttctgctttctccctcttccttctcctgcatctattcaggatacctaatgcggtcaagaggaacaaggcagaaatgaaaattttcaaatcctgtgtgggatttgaactctattcaaaacatattatattttaaataccattcagttgtaaataatcataagagcccacctacaatgaaacaatagatgacttgaaagcaccgcagcagccagctctgagctgcaaggagaatagttggtaaaatgattcattagcaaaaagaaatccctgcaggacactagatataatcccacacagggaaaaatgtggtttggagactgatattttacaacttcttcaggttatcaatattgaaaacaaatgatacaatcaaaagatattctttcagattgctatgtgcagtctcttccagtatctctcgcaggatactgcgagagatacttaacttaccttttgctctgagagggaaggctttcttgtgtgggtggccaagaaaggttatttggtggtattatatttcaggacttctaccagagtgattcacttataactggctggcataattattatagagtttcagtgatcattatgctgtgttaactacagaatattgtaattgctgttagaatgaccacgaaatgaaccatacaatttcaaaacatacttagccattttcagaagaggtgcaaatgagagttattatgctttgaagattccagggagacttattaagagaactaacagagtggagaacagattaatagctgcatttcttcatgctatgtgaccattagtgaactttcctttctgatattacctaatgtcaacattccattggaattcacacattgctaggtattttagaaaagacattgaaggtgatttgttgatatttcacccccagatatactgggaagaggctttcttctttagagatctgaatttctgaagtgaagtccctagaaagaatttctgaagtgaagcccgtagaaggatcaccattctattacagtggctcttttgctgcatgcttcccagatccctccatcctcctgcacttctgcattaactgcacttctgcacaactgcattaacacagggagcatgctctttctgaaaaaacaaaaacgagaaaaaacgctgctaactattttgttgtcatgaggagttgtgggccattattcgtggaccttctgatatttcaagagaagtaaaaatattttatatgaagtctactgtttacaaaatattgtcaattaattgacattaaacaaatgccgtgcaggccaaacaaaactagccctcggaccagaaatgctctatgggtttatagcttcaacactggaacatctctcaatatgatcagttgtggattatatactttcacccttttaagcacttattttaagggtttagtgggggtcaggtagaatatggttattgcttaactcagtttactactgctacctaaaaccatggttgatatttaactggcttgcactgttacattgcattaccaagtattcattctgattgattggtaccatgtggtcaaagtggttaaagtttttgaatattatttctgccccaaattaataaacaacacttcttactagcatgatttagatatgggtttacctgtacattgggagttttttccaagtgtgtttatttcaagcattgtagaatttctcagttccttataaggctaccttagagacgtagtttataatattttcaataatagtttgtcagactgtattctcacttattcaattttgggatattatttgatgactcctccccagaagcctcttttaatgactagtctgactgacatttggtgaaaaagcagtagttttccttcatctgtattcttcagagaatcatggaatactagctgtcccttccatttaggtcttgcttttgataaattaattgatgaagtgtcttcaccttaatatgaatataagtagttcagttgtcaattatgttagacttttaaaagactgttctgaatatgtcatcatattatgtactatttgtaacatgcttttttttcacccccaaataacaatttacaggatctcaatattgaggccagaagagattacatagagattataggctctgcctgtaatcccagtgctttgggagccaagatgggaggattgcttgtggccagaagtttgagacaaagttgggcaacatagcaagaccccatctctacaaaaaattaaaaaattagctgagtgtggtggtacatgtctgtactcctagctacttaggagcctgagagggaggatcacttgaacccaggagtacaaggttacagtgaattatgatcataccactgcactccaggctgggtgacagaatgagactccacttctaaagtaaaaaagtatatatattgaaaaaacctatttgaaaacttttagagtagaaattatctttattatatctagtctgtccagtcaaatgagctggcagtggaaggagcactggacttagagtcagaaggcatggccttttctcttttgtcaatcaatgtgacatttagattttcattattatcattaacattgttattattaggatttaaaaaaaattctgggctagaaatgtaactttcttcgtggcagaattttatacttatttttatttcatatgtgctcttccaactaagaaagaaaaaaactacagctctctggagcctgtagtgtttgaaacttattagctctgttgcctctggctacagaaatcaaaaaggagtttttcaagttgcattcagaaaagcagtctgtttttctgacctgcagtgttgctagtaattgtaagccaggtgttactcttggaaaatgaaagtactcattattttaaaatagtatggtgtggagggccaactgtaagacctggagctgtttgctgtttacacacatgcggacaacttctctggtcaaaagtgataaacaaatgaaactttcagcctccattcttcagcctctcaaatatatttctgaaaagggcattgttccagggttctctctgaacaactcccacccctgaagttgaaagtcttgactatttcaatgtccttcccttgcatcatatcgcctgggcagcacgcccttactgttgttgctttgttaactgttagatactgagttatattaacatcaaagggcataaggaatcagaaatgaagcctccaactaacaatatgacaaagctgatctaccaatacatctttgatttggttttaagaggttgcagtggaagtggataggaggtgtgaaatttctgattccaacttgagtctgattctagcccgtgccttggggatgtttataaacctgagagggaggaaaactgagggggaaaggaagagggaggaaaaggtagaggaagggaaagaaagaggaagagagaagaagagaaacagggagagaaggagagtgcctgatcctgatccatagtataatagcctccctagcctgattacagttctgcttttacacttaacccctgctcttttgggtactggctattgaggaacaataccctaaattttcctggaagttctttccagctgagagcatctctaggcactggcttaattctttcaaagtctcatggccacacccttgatttttatctttaccttgagggcaatcttaatgtgaaaatatttttctggcatgagacagcaaagatgaaaaacaactttagtttctattctaataaattctagcatctcttaattccccatattctccttgtaaattgtgtgtgtgtttttgtcgacatttgtttctttcttgtagtactttacatataactagtaagagtcagctgatattttcaacattctgcctggagatcaagtccaaaaattcataaggtacatattttgtatcttcaagttatcttaagtgaccagttctaacagatgtttcatgccgacgtagcatgggtgatcattttttctctttgttctaacagttgctcatcatttttccaggctttgttagtagtatcattgacacttttccagcttctgtttgctacctacctcatccaaagctaattccacgtatgtctgttttatgctacggtagcacattccttataggtactaatgacctatcgccataataatgctgcataataaacaacacaatatgcctcttgaaacaataaaaatttatttagtgcatgagtctgtgggccagcaacttggttcttctggtctcacatgcatggagatgggttgcatattagctgatctagtataactcatctgggatgattgagataacctggttctgttttacctttagtaggttagtaggttagtccaggtatgtgtcacagcaaagtcagaggattaagagactgttagtgtgaaagattttttcaagcctctgcatgcatctgctcttgtcctgtcggccaaagcatgtaagatggccaaactcagaatcaaagcacaaagaagtacactcctctatagtgagaggaaatgcaaagtcacatggcaaaagggcatagatacaggaagaagttgagagttgggccattactgccatcagcctgccaaattatctcacccgtatttaatatgggacagtacttcacccatattctttggacttcattatttcagcatgctccaaggagacagtgacttccaactggcagtatttgtatcctcttcccaagggtttccttctactaaataaaggaccagtctgcccatgcaaactccaggctggaggttctagggaattagccctgtctccacttgacatattcaatccaatcctcaaacagtaaatgataggagttggtttatgaaaatgccagctttcttattatccctctagttggataatttgtaggcgtatattttatacaattttccagagctctaacgtattaggcactggtagtgcacaatggtagctggcttcgtaatacaacttttatccttggccagtttcacttatgtactctcctaatgcttatttctctaaaaataaattgcttacacttgaaatcttttcttttttctttttcttttttttttttgagatggaatttcgctcttgttgcccaggctggagtgcaatggcaccatcttggctcacctcaacctccacctccccagttcaagcaattcttctgtctcagcctcccaagtagctgggattaaaggcgtgtgccaccatgcccagctaattttgtatttttagtagagagggggtttctcctgttggtcaggctggtcttgaactcccgacctcaggtgatctcgctcacctcagcctcaaaaagtgctgggattacaggcatgagccaccaaacccagcctttgaaatcttttcgtatggtttgctgggaacctaaattaatagactacataactgaactctcatttttcttctgattctgagttcatgttgcgtatttacactgtgcacaaaaaccagttctcagtatgtatccccttcctaattttcaggagttttaacactaaggtcttttcagtgcttatactcttcaggttcattagtaggagtctgtgtttttctgttttctgtagcttataacacaatacctgaaactgggtaatttataaaggagaggaatttatttcttacagttatgaaggctgagaaacccaaggttgaggggccttatctggtgagggccttgttgctggtggggattctgtagagtcctgaggtggtacagggtatcacatggtgaggtggctgagtgtggtagcttaagtctctctttctcttcttataaagccacaagtctcactcccatgagaacccactaatccattaatagattcatacgttcatgagggtagagctgttaggacccaatcacttcttaaaggcgctatttctcaagactgccacattggacattaagtttcaacatgagttttggaggggacaaccattcaaagcatagcagagtcctttaattgtcataagctttcctaattattagctttagtatgatctaagcatcaattttactttggttttccagcttatagaagagtacagcatacagaaaaatatatcttctgcaaagaaaacacagtcatgtagagaacctttccatccccagtctggacccaggtaatgggtccttgcttagaggaatatttcttccactcatatcatatttctttttgtttcccattttttttttgtttgaataaaactcatttggacttttcctttcttccaccaataaagaacattattgacttttaattataattttaaaaaccccatttttttgtgttttggaaacagggtcttactctgttgcctagtctggagtgcagtggcacaaccacggctcactgcaatctagaactcctgagctcaagcgatcttcccacctcagccctctgagtagctgggactacaggcacatcccatcacacccagctaattatttagttaagaaatgggtcttgctttgttgcctgggcttgtcttgaactcccgggctcaagcaatcctcctaccttagcctcccaaagggctgggattacagacgtgagtccctgtgcctggccacaaaacatactttaaaatctgtctacatctgcctagatttccagttgatgttgtagtccattaactctttaatctgctatatccaaactgctattaaatccatatatcaaattcttaatttttgttactttattttgcagttctcaaatttctatatgattattaagtctattcctttgatgaaactccccatcttaccctctatttcctaaacattttaagcacttattttaattctgtgttgctaatgacaatatctgcatcatctgtgagtcttttcccattgtcgattttttgtgttgttcctgtttgttgtgttgttgctatattttgtatacctggtagatttttgttgaatgccagatactgaatataaaaaaccagggatgatgtggattgtgttatagttttcctgagagagtttgccctgtcctctggttggaagctatagtggaggcaaatcaccttaatcaagtaaacgagaagaccaaatgctgggtttcagtcttcttaagattggtttcctgcagtgctatagcccctaaaggtctggaatgagagtatgaagtgttctctgttgcccctctcccttagtgagtcatggcctccagttttgtcttctcagcactaaaagatgtttaaaaactctgatttgattttcaacagctgtatgcttggcttcctagcctctcactctaatcagcttacttcagaaaatgcctttataggaaaacgaccttagtattgtgcttactttttcgcacctctcttctctccaggcttgtactcataaatcctggctgccttcacagcatcaacctataattttttgtccacctcgacttatgaattatcaagagctctcttagattatctgccttttagcaggggctgaggattattaatattccagtccatatttagaattggcaaatgccattaagggtaagtgacattcagaatttgtctcacctttctacatttctcttctctccaggatcttgacacctcagattcttatcactttggaagctctcccatgccttcaaacaaatgattttttttctttttaaattttactttgcttttcttattgttaattggttaaacagccccctcttgcatacctcttacatgtacatatagtttcttctacttactcttaggtcaattttattaaatctggagggagatagtagattatgaggacctaggcaaggagggtataatggacagagatgccttgcttgatcagcctctatttctccttcttcctaatattatttattattattatttggaaagccactactgagaagtggaaagccactttcagtccttgtgtttttcggtgggataaacccaatttctggggtctaagaatgggaggtgggtgggtaggtgtgacaggcatgctattcaggctggcccatgactatgttccatctctcctatcagagggcttgactccaggaaagatatgggaccctagtcagcccaaagagtgtcagcactggacttctacgaaagttagtgggaaagaggtattgtttccactgaggtttctcagctggtagatttaaggccagagctgctaatggtcttttttgcctttgtatgtgtaggacctgtgagagaaagcaggggaagcagaaccctttgatggagacaacagagtcaggacaatattatttaagtctcctaaatccaaacatgcctgaagctataagttacttctgaaatttaaaaatttataaataaattatttttcttctccataagccacttatcgctaaaataggcctgactatgtggagagtaccagtaggtgtgagggaggggagacagatgaagtgacatctcaatagaactcgctgatttgattggctgaagatggagcgtgtgggagaaagaggagacagataaatgtgaagttatttaaatgatttatgatgcttttaacccatggaaagatatgattgatgtagaaacaacttttccttttacatatccaatccacatataaaaacatatttaagtcataaactgtaaggatggtaaactagaaatttgtggctgcttctctgtagcaaagttttttctttaattattgttggcttaaaatttttgatacgttatatctctaagggtatacaaagtaacttgttgaatttgcaaagtgctttgtagatttcaaattactttggagtctgtcatttgaccctcacaagaaccatatagtaggtggaagagttaacatcgtcccttatttaccaatgagtgtactgaggtacagagaggttaacatagttaactaaggaaaccgagcaaatatcttggaaggatggtatgagaacccaaatttgccagtccagtgctttaccatatatcattcggttctccgattcctagtaattatagttacttataatcaatgataaaattatagccagtgaccaagttacccagtaacattccaaaaatggcatcacattttcttttaagcattataaaatatatttaatcaagtcagagctattctaaaagaaaagtaataactagaacgatcttggatgactggcttagccagagtccccatgtagatctgagtgctcattgtgggtcatggccactttcttgtatctcaaatatcctctgcaattctggaagggggagaaggtaaaaataggagaggattctggctcaaagggggagtgttctgtaaattggaatgatcactttagatggtgaaacattttcttgctagttatgtaattctgatatgcttttaacttccagttcctaggaaagaagttgtttcaactctcattggaggaagtataaggtgatctcagggaaggggagaagggctggttgcctgccaaatctatgatcaagtcggctccacagtcagttgagtaacccggagttatatatatgagaaattttggccaggagaaaggtgtaaataggttaagtaaattgacaaggaacaacatattgggtcattagtcaaaactcatcatgtggtctacataacataaacatcaacataaatgcaactcattttcccaaatagctacacacttcattttcaagtgctaacaaaatggggcttgatttcaattaatactaaataattttatgccatttccaaattttcatttctttgtgggaatgtaggaaatgttgagactaatgcaaagactttctgaacacaagaaaaggctttactttgtataattatctggtttgatgttctattgctacgtgaaagtgtttacatcatgtggtttcagaaccaaaactgtgtattgaatttcatccaaatcatttagttaagtctaagtttacaaaggaaactaatgatctggctttatttcaatgtattgattctggattcatgagcgtgtgtcaaaacgcgattatatactctctcatttctgtacaagctccctaccttaagcttacccctgctaagaaatccttggtgtattgattcttcatttcatcttaaactagtacttaggtaaaaatatgattagggccctttttcttcacttgagaaaagaagagacagtaattcgtgtgataaatcaatattattccaaataaaaacaaaaagcaaattctagaaatggcaaaccaatgttggatttggacaagactttgtggaacttaggatgattgagatctgtctagcatctcaggtgccctcttcaattttggcagaggcagaggtggaaatggggagaggactctggctcaggctggagaggggcttccacaaattgacaaatgtcactctacatagttttgaaaacagaaaacgaccttgctttataaaattctgtggtttgatgttctgttgctttgtgaaatactttttagaatatatattagatatctatatatcattatatattatatgataggaagaggggcagaaaaagaattggtttcttatcactaactctctaacaaaatatttcctttcttacttcacctgaaattgggtgcttaagggaggggatgggaagatgaggcagctgggaaagttcaggctgggtgacaagaaaagtaggaagaagacagatggtgtttttcagaatagatggcctctgatcagaagtagaggcatcatattgacattgccaaaaagatgggctctcaagctctctcctactgtagttttaaaaataaactattcttgttttatacaaattagaacatgtcctaaaaatatgttgggtgctcaggtgctgtactcataatgctcactagttagcaacctatctgacactttataccttaattgaaggccccaattaaatgctaatagaagttgcctttgattttgctggaattttgtgtatttcttattttaatggaatacttcatatatatgttttacttcaagtaggaggtaggatggttgtctccagagggtagggtgtgggggagggagggaatggggagctgttgatcaaagggtacaaagtttcacctaaagaggaagaataggttttgagatctattgcacagcagggtgactatagccaataataatgtatttatgtctcaaaataactaagaacaaatttgaaatatctcaccataaaaaataatgggtaatcaaggggatgaatatattaattagtttggtttaatcattccacattgtattcatgtagcaaaacatcacattgtatcccataaatgtatataattgcaatttgtcaatcaaaaataatattaataatttaaaatttttatttctttgtctcgactttatccttctaagtaggaattgtacatatgtcatagctaatattattttttcttagtcttaaaaatacatctacagtttctctgttaagtgtgatgtttgttataaagttttggtagttagcctttaacaatttcttttttcataattaggcttttaatttttgtccactttttcttgggccaattctggtaatttatattgacaatttagtattatatgtataatcatgtaacatacgttatatatgacaacttggaccttcatataaaaccagttatgtaactcgtttcaaattcatggtgttcttttatggatgaggatattttgactctcacacacccaaatactgctatgtatcctagttgcctgtttcttttaggacacctctgctagtggtgtacagaacttccactcttttgtgttagagaattatgcacttattaatacattttgtattttttttgtttttatttttttcttatttcgatagcttttggggtacaagtggtttttggttacatggatgaaatacatagtggtgaattgtgaaattttagtgcactcctcacccgagttgtgtacattgtacccaatatgtagttttttgtccctcacccctcttccacccacccgcttctgagtctccaaagtccattatataactcaatttgcctttgtgtacttaatagctttgcttccacttataagtgagaacatacagtgtttggtttttcattcctgagttacttcacctagaataatggcctccagctccatccaagttgctgcagaagacattatttcattccttttatggctgagtagtattccatggtgcgtatataccacattttctttatccactcattggttgatggacacttagattggttctatatctttgcaattgtgaattgggttgcaatagacatatgtgttcatgtgtctttttcatatcatgatttcttttcctttgggtagatacccagtagtgggatttctggatcaaatggttagatctactttcagttctttaaggaatctccataccgttttccaacgttgtactaatttacattcccaccagcagtgtataaacatgccactttcaccagatccaggtcaacatctactgttttctgactttttaattatggccattcttgcaaggagtaaggtggtatcttttcctttgggtagatgcccagtagtagaactgctggattgaaggatagatttacttttagttttttaagaaatcaccatactgttttccatagaggttgtaattcttcttttctgatttggatgccctttatttatttctctggcctgatggctctggccaggacttccagtcttaagttgaatagaaggagtgaaagtgggcatcctgggcttgtttcagttctcaggggaaatgctttcaacttttccccatttagtatgatgttgcctgtgggtttgtcatatatggcttttattaacttgaggtaagtagcttctatgcctagtttcttgagagtttttatcataaagcgatgctaaattttatcaagtgctttttctgcatctattgagatgatcatatggttttgtttttaattctggttatgcagtgtatcacaaatttattgatttgcatatgttagaccctccgtgcatccctagggtgaaacccgcttgatcgtggtgtattatctttatgatgtgctgctgtatttgcttagtaaatactttctggggatttttgcatctatgttcattggggatattggtctgtagttttctttttttgttatgtcctttcctggtttggggattagggtgatactggcttcattctcttatttctatgtgactggtatgcagagataagggtttcaccatttgtacaaatttgcagttttaatgtgaaatatgatttttagccatttgatatttttttctttcttaataaattgaatgaatatacacacacctattttgatgctgtgtgcatttaaaacctcatgtactttgtcactttagctttatattgcagattcccttactctattgtctggacttacttctgcccaccattttgcttactctgtaggctcaaggggtgaatgccagggatgaggtaaaattttggtcatatatatgactgattttttacaaagatgaaattaaaattatttctttagggccatgtaatatcacccaaatcatgttggtcagagtacaaactttcacttacaagatgagtaagttctgggaatctaatatgcagcgtgatgacaatagttaataatactgtacagatgttccttgacttacaatggagttatgttccaacagattcaatgtaagctgaaaatattttaactcaggggtgtcccatcttttggcttccctgggccacgctggaaggattgtcttgggtcacacataaaatacactagcactatcgaaagatgatgagctaagaaaaatcacacaaaaaaatctcataatgttttaagaaaatttacaaatttatgttgggcctcattcaaagccatactgggctgcctgttgcccatgggccatgggtttgacaagcttgttgtaacttagaaatgtatttaatacacctaggctacagaatatcataggttagcctagcctactttaaatacgcccagaacacttatattagtgtacttgggcaaaatcacctaacacaaagcctatttagtaataaagtgctgaatatctcatgtaatttattgaatactgtactgaaagtgaaaaacggaatggttatatgagtacttaaaatgcagtttctactgactgacttttacaccatcttaaaattgaaaaattttaagtagagaactgtctgtattgtattcttgaaatctgctaaaagagcaggccttaaaagttctcactacacacccaggtaactatgtgaagtgatggaggtgtcgactaacttgatatcacttcacaatgtttacatatatcaaagcattgtaactcaattgcagattcagtcactcgatgcttgccgagtccagtttacaagggtgaggtctgatataaagaaagtgactttttaatcgaaagtttagcttatggaaagaagtccaggctcttgcctttaaaggcactgcttcacttttggggcagaaagccagagcttttaaaggggaacttggcgtgaatggcaggcagggaaggagcagttgggggtctaggcgacttgctttgttgccttatctacccaggggttgagctagtgctagactgtaaggtggctgtggtctggagatactctccagatgggagagagtttcctgtgggcaaactttaggttgtaaattgactcttgtctctagagacaatcttctggtgggagagatttccagctctggggcttctaggtatgcacacagttagatgagcttgtcctgtagtgtctggtgaagggaaggtagaggttctaattgcatttctaaagagttaagtgggaagtggggaacaggggcagaggaggaaagagaaaaaaagaaaaaaaatttaaaaaataactcgttctctttctcttagggaaatggcagttctgggttacagcatcccattgtacacaaaacttgtctaacccacggcccatgagctgcaagaagcccaggaaggctttgactgtggctcaacacattcaaagaaagtttgtaaactttctttaaacattatgagattattttgcggttttttttttttaagctcatcagctgtcattagtgttagtgtattttatgtgtgatccaaaacaattcttcctatgtggcccagggaagccaaaagattggacacccttgctgtacaccttaaatacagagttttgtgtttcaattttccctcagttaagctgggaaaaagttgccatacccaaaaatgacacataaaatagctgtgtcaaatttttattttaatcttgaatgtctttcttttacaataaataaacttctctcacatgattttttaatagtttcagagtgtttcattttatggatatttcagaactcaataagttcctatttatttatttatttatttggacactgtggcagcgtctaatttttgctaaatcttgagacacattcttaaatttcaaagctggaattactgagtctagtgggtcttaagacatattgttatctgcctctcaagaaggttttgactcacttcaaatgaagtcaaacatcttctccatgtatttaacattcaaatattttgcatgtgtgattgttgtctttgcttattttttgagttttcactgagttacaacaattctttggtttactataaaaagagaaaaaaatcattatgagccaaatggattttgagaaatataatctgagttttctctttacagaggtttttgttttgtttttgcctagagcatagggttaactggactaatttacacttttccattagctttatcttattcaggataatatgagccagttttcttaaccctaatagggcatatttctgttttttcttaactcgttctttttctagtgtattgctaagttttccaatttagttcttgccttaaaaatgacgttgtctaacattataattgtaaaatactggaaaatggttttgtcattcttgctgcaggcagtcaacaactcaaggtgactgaccactaggttagctggaagtacatcttgattggtacagattccggtttctaagtgaataagcagagaacacactgagtgcctgacgatgtgacatgctatcatgtcacatgaaactatcagaacttgctagggttccagatcctgcactagaaattcctcccagatgagggtttttttttttttccccctcctgtgagaaataaaccagaagaaaggagaagatggatttttgcaatttagtttcatgattttaaggaccaaatctcaactttatttctctagaataggaaatagagatatcattgtcatcttatgttttttctcacttgatctgatctatgatctgttgaaacttgatcatctgttcttgcaagtgaggtttgttgctacatttctgaacttcaaaattagaaaaataatatcctgaagcttctaatacttacagttgagcagactttatattctgtttacacttaccattttacataaatctttatgccttttatttagaagacaagataaaaattaaaagagaaaaaatatcccacatatacataatacctctctatggactattcttttgtgggataaggtaggtgggagaatgggagagtagcaggcccattagaatacaaaacatgtaagtaactattatttttaaattggggccacttgtacaccaagatatgattgcctttttaagagatccatgttctagagaactgatttccttaaataactcatttctgtttccaagtttctactcacaaatgtactaatgtcctaaagggcatgaaggatatatatatatatatatatatatatatatatatgtagaacagtgatacagtaaatatgaacagtaatatagtaaatcactgttcttcaaaatatatataaacagagatatagtaaatcactgttcttttataaactgggaccttattctattttttatccctataataatatattttataacttctgtttagaatattggcagataatagaacttgattgcctgattttcaatttaaacacttatcaatcaaatacataagtacttgttcagggtggagaaaagttaatactttatattatctatgtatctctgaaagacaagaaagtttctgtacatttacagactacaaatatagaagttaaagcaaatgccttctagctggcataatcttaggaaaaaagcagactaaagtattataaattggtagcagaagatgtgtaaagacaagacatgatcacctagataatataaatcaattttctattcttttgctgaagcctagaccccacacggcagcctgatgtaattccattaccatgcttaattacttggcacttgtatagcctttttatttttgtgttactgttattcctggtaaatcattcagaagaaataaattagcttgccactcaaaattaactactatggtgcattgctgccccaccccgcaaaagatgagttgacagctactgggcgttaatctagccattttttgataacagagtatctctttgcacatagttatgagagttataaacattccaaatgtaattatctcagtcctttacaacttgaaagtctaattaaagaaagtttaagacactataaatcttaaggaattaggtttataatgtggaacccagtcagagtttgggattacattggaaagtgagtatattgaaaaggattgcagaaacatttctctcagccagaatttaattgctcagaaaactgaatttcagtagaatagatgaaaagtgttaggcagagagactcagacctatgactgctgaagaaagagctaattccatatccctttttctagatgccctggaatacacttgtgtcagtgacaaatgctgctttgctgtgctacaccgagtacaaggtcgtggtaagacatgactgggaagcagttaccagagacaagcaaggatagcgctttgactgcatcctctgctggtggcttctgtagttatgcataaaatttactctgatctgtttacttttatagcctgtctttactttgtttcttttaatattatgcatgtttaggctatgctttttctttaaatatgtgagcaaatctattggtgtaatgtactcattaccctaaaacctatattttaatggacctgaagaccataaggtagaagatcagaagaaaaagaaaatgcatacatttttatctttaaaacaattcacttttaagattattttcttgaaaggtatacctttgatggagccgaatctggttccttcaggcagatacaataggatacaataggataggacttcttgggtaaaaaaggtgtagtaatctgtgagtctcaccggaaggagaaaggaaattattcattaatttggctgaggccagggtagtaagcagatttattataaatattggcagcagaggagtacttgaaaagtgcttataaagttagatcatctatttttccaagcaatattcttcatgtcattccaccttgcaaaaactttgtggaaaggaataggcatatgaatgagcaatgaatagactttgcattagattggtaatcttgctactagtacattaatttacttgtattactgatattttaagataggatttttacagatgtttatatatttttaaaaagcctatttttttctttacccattttctcaatttttttaacctcgaaaactttttcctccctgagagaaatacatgggctatcttcagcacagaacacaaactctgccttcttttctcaagtccagtgattcaagtttgacacaccacaccacggtggatgtgcctttcatgacgcatcttctcagcagcactagaagatacatccaaagtcctgtgagcaaggtaagccttgtagcaaccctttgatgtctttgaaaaatgcaaaaatgctcaccgatcaggagcaaaggggccaaagttgaggtatttccccctcacatgtagtttttatttttttagcctattttttgtttttctctaaatcaaactcagacttactctgtttacactgaaatacactgcacagtgccgtaggtgtaatcagatacagatctcaacaatgtgtatgattccatacccagtataaataagggtttaatatcaactccatctctgagtgaaaataaatacctctgaaaagtcaattcttcctattttcttttacatttggccttctaacagctgttttgtgtcatttcctttgagagctctgataccaagttggaatagtccattatatcctagctctcagtctttactgaaagttacatgaaagaggaggcctttgcctgcaattcagaattctaaattaccagcctttcttaatttcaggttgtccctcctggacatgttgtaaactcacgcatgggcttttgagttagaaaaatttgtgtttggaactttttctcagctcttggcttttgacctggccgggttaattttaaagccacatcttattttattttattttattttattttattttattttattttattttattatttgtcatcttaagaatggggataatgaaagtgccagcctcactgagttatgttatttgaatgatatagcctaagtggtgaacctagcttagggtctgttacctgggatgatgctcagtggaaagccaaaattttttgtgatgtttttgtttatatgctgatagcatataaaggagtgtctcaagtcccatcacagctttcaaagctcctcttccttttgtctgagcaatcagtgagaaaaatgtgaccgtcaatgaactttagtactgagatgtgcttaggaggtatggtcgttgttaggtttgataattatcaaagagagtgattcacgtcttagaaccctgacctgcagctctaatgccccaaaagactaaccattacccatagacactgccactgccctctagtttgcttgtctaattatatgttaactataattaacactttaaatgtgagaattcctacctaagaaagtatattacctggtgcagagcctggcagagaggaagtgtgcattcaatatatgctcatggtttattgagtaaatccagatctttccttgctactgggttagaactctgggagcatacatttacggacttagcgaatctggaaacagctggatatcctttggggtgatctggaatagtttctcattcttcatttctactaacatttattaagcttatgtgtaagctctagagttggcactcataacttcatttaatcctcacactagtcctttgaggaacatattattcctatttttcagataagaaatttgagacttaagcaataaagtgcctcactcatagcaatattactagtagcagctaagttgactatactgtgtgaacctgtgtcacaccttagttgctatctggatagtagcatgccttgcctagcatggatttggggtactaaactctgtacattcggttgtccccaagatccttccctgagagcatattatttagacctattcttatttttaggcttgggccttgttgtggactaagtgtctgtggttccccccgcagaatgtgtatattgaagccctaacccatgatgtggctgtatttggagatgcagcctctaaggaagtaattgaagttgaatgaggtgataagtgtagagccctcatccaacaggataatgtcattataagaagaacaccagagagctcaccccctctctttctaccatgcaaggacacagcgagaagatggctgtctacaagccaggaaaagagtcctcaccagaaccaaaccctgctggactttggtcttggacttcccagcctctaaaactgtgaagacataaatttctgttgtttaacccacacaggtctgtggtatctgtttattatggcagcccagtgagactaagacaggccatcaaaagacgtgaacgttttggaccttctcttgggccctagtaaacagaaatcaggtatgcaaaaggagtaaatatatattttcctttatttttatttttaatgtgtaagccttgggtttttatttatttacttgctgagaacaatcacactgtatgtacaatataattatattgttgatgagaacttacttaaaattttttaaaaattctaattgatttctagatgttcaaatgacaagatagcatttatataccatcagaacataaaataattcaaaaagataaatttataaaacaatatgtattatattgagagagagagtgttggaagaatatatataaatacaatgtgataatgtgatgtctttgtgagaatgctatatgtaattttctttgtttttgtttatatgaatttttaatatttttacctttgaaatatataaaagagaataaagtcattgacaaaatcaaaattcactctattttcataggtgagtaagtatacatctttaacagaatagtaaagagttgatgaatgttcagagatattatataagtaacaggtaagaagtgtcctgatctatggtattcattctcagttgcacatatatatgcaaaaaaaccccacaaatgaaaccaaaacaactcagaattctcatgaatgttgcataagtaaatatattatttggaataaatttaaataagctacatacaagatgtcttttagttgggttgctgaggggcccccattttgcttttctgatcggtattgtagaagagctttagttttgtggagtccctctccagggaattattagggtgatgtactgagatatagaacagtggatttggagtcagtagacctggatggaactcatctaccaggtgtgtcactgaaaaagtcatttaagctctcagagctttagtctcctcattagtgaaactagcataacaattctgtgtcctttacatggtttcatcagcatcaaactaaatgaaataataagtgcaaagctttgtgacccagagcactctatgctaatgctagccatcattattctgaagatgactattataatcgaagttatataaattaaagaaatgtgacagaagttgttcccctgaaaatgttaactcttgatgctgtagtcctaattatgctagtgcaaatccctttaaatattcttaatttctggtctgatcttaattaatggataccaatgtaggtactttgtatttttggcagacagtaaaacctggagttcaggaacagcaatgtaaacaggctctaagtttgcaagttccaactttcatttatttgatatttgtcatgaaaatctatatagtgctttcagtgttccaaggcctgtggttacagcagcaagtaaaacaaaattcctaccccactggagcttacaatctaatgggaggagggagagggccaataatacagtagaaaatgaatatatgataggtccgtaatgaatatgtgatatgtgaatatgtgatacagcaataaatgtagtaagtgctatggagaaaaaacaaagcagaataaaggaaaagttctgtaggtcagatgtgcaggcagcagaatctgagatggagactgaagtgcaggaagttcattcaaagtcttctgaggaaggaagcagggttgggtagagagagaagatgggctccgaagcaggcacagttgggcctctgccgactccatggggaactggaaagcagggatgggccttctgattgccttgtcttggggtatggaggccaggcctttatattcctgcaatggccagaaattggatgcaagttgtcccctgggaaggggaatgtgaccttggtgacatgacttcctctgctgagggcaattcccagagagggctgacagtagtgagcttccagccagtagcactgtgttcattacaggggtgtgtgtgtgtgtgtgtgtgtgtgtgtgtgtgtgtgtctgggaggcaggaggtgagattgcttttttaaaggataatcaagggagcgtctctgaaaacattttgggagtaaatgtgaaggacatgagggaggaacctcatgaaatctgggggatagcaagtagatatctggggaaaatatttctgaggaagataattttgaacttctttggatttttcatatggattgtctatatgagtaatgtctatgctcatctattgcttttccagtcgtgcttatcatggtagtagtaataatagtaataacaacaataaagtcatttttaccatgtcattgcaagctttgctttaggaactgatgtaaatctttcataagatcttactagagtattaattagctaattagttaatttacttattcattcagtcacacagtgagtgtttataaatgcccactgtatgtcagttactatgcgaggtgcaatgaacaccaggtgagcaggacgagttagtccctgtgttcgaaactgttaaggtggggagactgacaaatgaaacaggcaattaaaaatgcagtgtaaacagtggtccagtgtagttaaacgaggtaaggaaggtgcagcagggaaacaataagccaaacaaagaagaaaccaggtgtatgaataaatagggaatggcgaagctttctttgaattggggtgggatggggtgtatggaacagaggtgggcaaagtaggtgagataagtggctttggaaatgaaaccaagttttgtttagtgacctcttacattgtcagatggggttaaatccataagggtctataaacattggcctgctatgtagaaaacacatgtttcaatggcaactcagttgtgggagaggttttcattgctaacgatgggctcctagcatgaagagattcaggtaaagcctgcctcgaggagtgggctggtatctctgatcagagctggctgcaagcttgagtagtgacaatggtgagatctccaaaagtgccaactcctaccacccaacacccaggagagaataacttcttactgccccctcacagatcctgagctgagctaaacaacctcttcagttctcgcaatccgtctctctccccttctactgccccattcatgctgcaaagatgtcacaggactgtctacttaaagattacctctctaaagcagagttgactctatgtattctgtaaaggcaattcttttttttttttttcaacactgacccaagaacacttggatataaacagtaatatcagcatggtcagaaggtggaaattccactggctttcttgtttcatttaacattctttgacttgggggtgatactaaaaatataaaaatattatagaacattttcaaagtcaacttgctttacaagtcccttcaaaatattgtttgtcctctatgttcatagcaattttaaagtgttcgtatgtaaaatattgtgtctacatgtacagctttgttttttaatagtcacttctagaacaggctgaaagtcagtcaggaaaattaagtaagaccgatttgtggtttatccatattcttatgtaaacctgagattctcacatttgtcactaatgacagtcataaaataattaaagacaaatgagttagtattttatcatctaaaatttccccctttttcctgaaccttcttacatttctagaaaatagttaaaaggaagtctgactgagacctcaggacttactgctccaagtaaaaagtaggctgaaaggaaagttaagtcattgaaaatggtatctacatttactttcccttttctttgtactgtttgctcttcactttaaattcttttgattccagaaggaagaaaactttgctaatgctctgccaagcctcacttttctgtcatgattggaaggtttgatgttatccagaatttctcatggaagatggaagagctgcagcattacaatgaaagccatcttgcaacagcctgagttcctttttcttttacctgagtcaggaacaaaaaaatattcatgtatattccccaaaaggacaaaaaaggatccaatgaaagggctaggttgtagaaaggtcagagcattttagtgctaaatgacaactaaaatcactctctctgcacaccttacattgtaaaagagaaagttaagacccagaaaaagatcaagagtttttcattggtcgttacgatattaaagaagttttgaaatatatggctagctttctcacatctatgagctgattagacctcagccaaagacttcacgggagccctctgcaagtttctagagttctttgtgcagcttttcctcttgggttctctgacttgcaaactcaaaccgccaggcttttcttagactcagctctgcctcctcatctcagagagaccctacagtggggcctgggaaccctccaggctctgagctggacaatggagctcacctccattttgtttgattcctctctctcggcaatcactcttctgtgctactgatgtccggtgtctgaaattcatttttttcatatcttttgttgtttgcttggtgtcatttcctgcaggagggtaaatctggctcctgttgttccatctgtcctccagcagcttcccatacaggcagctcacttcacttcattttcaattttaatgacttctgttctttattacgccttttgtctacttttttttttgttttggttattcttcttgttctttttctaacttcttgagttcatattaagttagttagcttttagtccttctaagtcaattactgaatgttttgaagttttcactttgtgttactttatattttttaggctacttattaaactaaaccacgttctgaactgttactgctactggaaaccagtcccgatccagaccccaaaagaggattcttggatcttgcacaagaaagaaagggtaagtccataaagtaaagtgaaagcatgtttattaagaaagtaaaggataaagaatggctacttcataggcagggaagccccgagggctactggttgcccatttttatggttatttcttgattatattggtacaaagaggaggcaaggaaatattgggtagaagggggcagttccctggcaaagacaccaccctcaagcttggaaatccatggccctaaatttgagcaggcattcctgttttcacaccttaatgttgccttttggcctgccacaccccccagtcctatacccaaataaaccctaaacctcagcctccaagagcagaagatcagaggagcagaagatcagaggagcagaagagtggtgcagcagagaaggagagaagagaaggaatgtctaaatgtcaagaggagttcagctggggatagtcagagagaagataggccatgggacggccaaactctaggagaagatcatctttccactccatcccctttccaactctccatccatcccactgacagccacctccaccactcagtaaaacccccgcattcaccatctttcaagtctgtgtgtgacctgattcttcctggacaccggataaggacccggataccaagaggtcactgagctgattaacacttaagccatctgtgaacagcagagctaagaggcactgtaacatgcgcattggggctttgggagttgcaggcactcacccttagatcctaccacgggtctggagcccaaaagcactttctccagctcttgcacctgcctatctgcatgctctccctcccgtaaggtgtttgagctcctggtggccaaacagagaaaccacacctctgttgcatgtcctgcaagttgggggtcagggaactcccctgtttcaacatgttaaacaaggggtggattattaatgcctcccctttttagaccataaagggtaacttctggacgttgccatggcatttgtaaactgtcatggtgctgttgggagtgtagcagttaggacaaccagaggtcagatcaccatcttggttttggtgggttttggccagcttctttactgcaacttgttttatcagcaaggtctttataacctgtatcttgtgccaacctcccatctcatcttgtgacttagaatgcctaactgcctgggaatgcagcccagcaggtctcagccttattttacccggcccctatccaagatggaggcactctggttcaaatgcctctgacattacttccaagatgattcctttttgtcattacgtagtggcccctttatctttgaaaatgctttatctatcatctattttatttgatattaatatagcaacatgaaatttctgtatttttacctatttattgacatgtaatacccatacaataaagagcatgtaaggcactgatcttaagaatagagtttgatgatttttttctaatgtatacagccatgtacccaccacccagatcgagatagagaatattgccagcatcaaaggaagtcactagctttatttcagttggtattttcctcagacatcttttttttccatccattactttcaacttatctatttatgttttaaagattttactttcaaacagtacgtgacttttagtaaagttacagtacattgattgattgattgttaccttaaaacccaagccactaagtatcaacaacatcctctgttcctattttcccctcaaataaaagtagacttaccatatttgtttagaatttctgtgtctgccaagggagtctttaattgctaaaactaaaagactctatctatatttgcttttagtgctttcctgtttttattttagtaaattaaccttaattatgtgaaaaattttatgttgtaaagaatgagtagtagagatccatttattttttcttcagtatctgacaagttttctgaatacagtgaaaatctatctttttatattgatttgaaagctgctttcttcgtgacactaaattattacatgtatttgaatttacaaatgaattgttatatttcacttatctgaatatatatttctttacccagaatgttcttttaattaatgcttaatataactctatattataattcctggctgaagaagttcccactcattgttcttcattttcataatttttctgactattaacacatttattcttctagatggaggctgttctaccttggcactattgatattgtggactggataaataaacatcagtagtgggatccttctaatttcctctactttctttttgtagctctgtttggtgccctcaggtgggaatgctatgtcaactctccagtaccttctttctttttggcccaaagcagatattctgcagagtttcttgtatgaggttgggttgtttcttaaatttcagagtagattattgtttattctatacttttcttcattcaagcagatttcaaatagatggaatttttaaatattttctcaagcctccatcttctcattttaactttcttaaagaaatatttaaattaccattttcacttatctgttttttaattgctctgctattgtttggtatttacaagtgatttattattttatcctttttattaggtaagagatgttaatggtgagtttgagattgataggagctattttattagaaataaatgaggaactgttgcaagaatggactgtgatttttaccttttattcaattgttttggcttcttacaggctcatgacactttccttagtgtttaacacaaacaactaaagtaaaataactgccatttctctccttgcagttaaactgcaaacaactctttttataagaactgtgattgcctctagcaagcagtctcaagtacttgatatatcaacacactattgcccctttttttcacacctgaagtttgtagaataaaccactaaaaatttcatagtatctgaggagaatggatctctccagatgatgttttcttgcctggggccaatatgtgcaccatagagtcccctctatctgccataaaactttgtttatgaagcattgctttaatcaatcttcacatggtaggacgatacaggcaaaagctgaggtcttgctatacatctctttcaaagttttccttcaagaccattttgcttttagtcacttttttttaatatttttggcagcagttatttatttcatttcattctatttgacccatccaaatgtttaacatggttttataaaagtaactttattttcagcttgtctgtaggttcagttttcttgtagttgctagtataagtaatagggaaaaatgtatcagtcttatacaataaagacgttcagatgagtgtgtgtgggagtgtgtgatataggaagaagcaatcggtatgtaacaacatatgtctgcctgctacgcttttaatacttgttagagttttagtttctatgagtatcttggaggtactggaatatatatgcaaatttccttctaaaagattgcaccaacttacattgccataacaacaataagaatttactgcaaccttagcacgttggatattatataagaaataccacttagtaggtttcatagataatggataaattttctgttgttttaatttacattttgaaagtagtgaagttgaaagtgacgctatttgaaatgcatgtgcataagaagttgaatagaagtttattagtcagaaggtggaatgagttttgaacaagttaattgttttgaaaaacagtatgaatgtactgaatacttttgaggtgtgatcttctaattgctctagcaaattgtattggtcataagaaaatgtttgaatttttccagtcagtcagtcattgtattagttcattcccatgctgctataaagaagtgcctgagactgggtaatttataaaggaaagaagtttaattgactcacaattctgcgtggctgagaaggtttcaggaaacttacaatcgtggcagaaggggaagcaaacacatcctttttcacatgatgacagaagtaaatggggaagagccttataaaaccatcagatctcatgagaatttgctcactatcatgaaaatagcatgggggaaacagccacaatgattcaattacctcccactacattcctcccacaacacgtggggattgtgggaactacaattcaagatgagatttgggtggggacacagccaaaccacatcactatgcccctgacccctcgcaaatctcatgtcctcacatttcaaaacacaatcatgccttccaaacggtcccccaaagtcttaactcattctagcattaactcaaaagcccaagtccaaagtctcatctgagacaaggcaagtaccttccacctatgagcctgtaaaatcaaaagcaagttaattacttcctagatacaatgagggtataggcaatgggtaaatgcacccattctaaataggataaattggccaaaaacaggagctacaggcccatgcaagtctgaaatccagtggggcagtaattaaatcttaaagcaccttaataatctcttttaactccatgtctcacatccatgtaatgctgatgcaagaggtgggttcccacagtcttgggaagctctgctcctgtggctttgcatggtacaacccccctctcggctgctttcacgggctgttatccaattccaaagtcacttctgcatttttaggtatccttatagcagcaccccacctctagtaccaacttactgtattagtctgtctcatgctgctataaaaaacttcccaagactgtgtaatttataaagaggtttaattgatctacagttttgcatggctgggaaggtctcaggatacttacaatcatgaccaaaggggaaacaaacacatctttcttacatagtggcaggaaggagaagaatgagagctgagtgaagggggaagctcctttataaaactatcagattatgtgagaatttattcactctcatgagaatagcataggggaaaccaccgcaatgattcaagtacctcccactgggttcctcccatgacacgtggggattattggaactacaattcaagatgagatttgagtgggaacacagccaaaccatatcagtcattccacatattgagtgatttctctcttctattcactattcttccacagagagggacctgtagtcattaccttcaaggaacctaaatcctggtgtctttatggttatgggtggcatataatatacaggtaagccaatgttacaggatgttgtgagactattcctgttcttccataattagccactaggaccacggctgaaaccaagaggcactgattaccgcctcactctaaagagaattactgagtttgtgctcactgctggggccagatctctttgcagggctatgtttggctttacacaatgtgaccctctagtctgtacaaggagaggaatgcagagggaaagagattcactggagtctctcgtcagtgacctggtggtgaatatatggtaatgggtaaatcccacttcacctgatgaagaaaaggagaaggatgcacttcattcttagaatctaagcaggaacaggaaagggaaaatctaggagaaaagcttacaaagactaaatgtcttcaagaaggtgagagaaactaatatttggtttactgtcagcaggctgtttgggcggcattttgccaatattagccctatccctacgtgagtaggggaaagggaattgtggttggacaaccgagttctgagaaaggcagtgattgagcagctgaactccatccatttggtgggtaaggaccccagagtattcaaaggatcaaatggaatgtgactgaagagttatcttgccgatcttacccaggaagactgtcccctaggcaaggggacaccaaacacaaagaggcatgggataaggatttcaagatgagagttgggcagaactggagtttaatccccatgtcatggtaaggccctctgaaattctctctatgcctttgagagactcaccatttagattctgactcctagagtcccttagtggccagtcaacgtaagtcaagttagtagctacagccgtcaggcacacgattacaccgtgaacagtgaagtaaaaaaatgtcctttctttgctttcttcctctaatcaccatcccagaggcatgaaaacctagaaaaaagaaagtagctgtatagctttcatttatgtgtaagattggtgttttgaaattttaataacaaaaaagactagaaagttgcctatctccccagaatgtttctagtgaataggaataagaaataggaaaagtatattccatacagtataagcaaatttaaaaaattgattttttaccctactgaattgagacttgccaataaccagttatacaaataaagagggtagtcctgggagctgagtgctatgaaaaaaatacaggaagaaaatgaaagagaaattaatgggaaggagggaagaagactacaagctgctttgcgttgggtaggcagggaagacctatttcattcaatgaaattttcctgagttttcctgtgttctagccattattctgggctctgaggatacatagtaaacaaagcagatgaaaaatacagtcatcagaattttctttgaaggtgtgagacaggaataatatggaggcagtcaaacaaagatatgaagcaaaaaaaggagaaaaaattagaacaaagttcctaagaaaggagcaagcttagtatgttggagttttggggaaaagttcagtggctgcaacctaatgacaggagagagtgggagagggttgaagggggcaggccaggtgagctgagcatgtggacaagtcagaacttcagagagcatgctaacaagtggtgattttattctggtgcagtgaaaaacctactggagattttaagtaggagaaatacatgatctaattgatagtttgaaaaaattgctctgtgaaggagggaatataaaaaacaagagtagagacaaggagacaagctgtggggctgttactatattccatgccatctcatccattctttttagtaagaataaatgctgctggtcaccttttagtgattactttttaaaatttcaaaatattcagagatggggatactttaatctgaggacattaaaatatacagcatttttatgctttggtagacctagaaaaagtttaatagacttaggtaagacttacattaaagtgattacttttgatttaaaggtaatagcgttcagctgagaatggaaataattttcacctggttggcaatatttgcaatcacttctgaaccttcagttttatccagttgaataataaaggtctaaaatttccttcatttgcttttgtcagagcaagttatgttaccaataataccacctacaagagagaagagccatgagaagtgtcaaggacaatctatgagtaacttaagtggaggctgatataacatattctctaatatatgatgccctgatagcatttgacaagaccatttggaagagacccagatggagacaacaattctagttaatatgctccattgagtgatgttcatcagctgattgtgtgaactcaggctgaactctagtcataaaatttggaaagaaggcagtttgagaaatggtatattcttcactgtgaaatgattgacctgagcatgaaatcaattctaaaaataactaaggggcagataagttcatgaccaagcttataaaaatgagaaccactcaaaagatctccagttttattcctaaacctatctgtgctgaagagctttttggatgcttcgcacaggactgaaattcttgcctctaatttggacaatgacagttctctgtaatccacaattgaatggtcactggaacatgttagacacgcaacatagtcaaagaatgcatagattagggtaactatgtcaattataagtaaaacccctgtagactaatgtaactctatctgttagggagatgtgtactagcaactgtattgttgctatatgtatatatgtatatatatgtatatatatatctagttttgaaaaagttaatggcttttgttattgtctctttaaaaatgtaatatagttttgttacagaaaattaagaagctagaaaaaaagtataaagaaaaagatgaaaattagctataatcccaacaagtgaaattaagctctatacatatcctggcatctcccccatcccacaaacccctcacccacagaaagaacttttaatgtagaactgtctgcaatcttttaaatatgcaacaaacaccattccttgtcatcagacctaccagattttatcatggtgtgactgtaatgtctgaggtttctgaaatactttagaatttatacattcaaagcagtcaccttgagaggtaataacattcatttattcaaatgcagatgctgaacatagcagatttgtgacaatctcttactgctcacttaggggaggcatacagcatatggccatggcctgctctatgtcctgtttttaggatgggagaaaagagacctcagacactcctccttctgactccaaggataaggcagtcagaatgtatctggtgtgtactagaagaggaaacatgctgcacattgggaccccaggtcctttggttttacctgtcctttctgaggtgtgggcatcctggggtccctcagagatttctgacccagccatctcagtaagatctgctgtgtcctggaggtgatgagtgctctccagagttcatttgaaagtcaggcccttctctatgtgctcctacccctgtgcctgtcattctctttactgttgaggagggaccttaactcctggcaggcgaactataattaagatcaatgggtactaaagtaagcctatcagaaatctggtttttgacaaagatttgaatagaacttggtccttgccctcaaggatctcacagtatgataaacttgtctttgctttttaaattacagtgccgtttcagcagtcaggcaccttgggtacttgactgaatcttgttcttttccaatatatttcacatgagacttcatgttatcctggacaaccacctaatgagagtctaggctgaagtcttcattccccttctgcatgtgctctgctgttggctttgttcagacccttctttcttctcatctatcctactgtaatgggctttacattttaaacataacttgaaataacaaatcatgactataatacctgcaaatggtttgtattttgttttatttttattgagaagtagagaatacagtaatagggaggaaaacagggaattaggatagccaagggttggagcataagcaaaggaatagcaggtgcagccagtctgcataagcaagagaacagcaggtgcagctggttctaggcaagatcaggcagcatgcaggccacatcctcattcctgtgataaaaagacagaagtttccacttcagcctctgcttgaccatgagctaagcctccacttcagcctctgattggtcacaggccaatccttcatagggtgtagccaattggaggcttctaaagggtacctaaggggtgttgccaagttcttttggctttataaagaccctaattggggccgggcacagtggctcacacctgtaatcccagcactctgggaggctgaggcaggtgaatcacttgaggtcgggagtttgagaccagcctggccaacatggcgaaaccccgtctctattaaaaatacaaaaaaaaaaaaaaaaaaaaaaaaaaaacaaaaaccaaaaacaaacaaaaatattagtcaggcgtggtggtgggcgcctctaatcccagctacttgggaggctgagacaggagaactgcttgaaccccagaggcagaggttgcagtgagcagagatcatgccattgcactctagcctgggtgacagagtgaggctgtctcaaaaaaaaaaaaatccccaaaaacagaaaaccccaattggagaggctttgaaccccttgcttaagcccactcccagtctgtgaatggtcttcaataagtctgtgctttccttactccattcttctgttgctttgtctttcattgctttgttcttttgttactttgtgcattttgttcaattctttgttcaacatgccaagaacctggacaactctgttgggtaacagtggttaccagaggctgctggggtaggggagatggggaaaggaaacttgtaaatatttttgaaatcaaaattataaggaattataataaaaattattaatgaacattaattaatcactaacagtgcaccaagcaccattctaaatgattggtaagtattaactcaatcctcactattgctctttcagaaggtggtagtgttatcgtcagtacattttacaaataagaaaagtctcagagagattaattaacttgtctaagacctcacaactagtaagtggcaaaacttggattcacacccatgttctctggccataaaaactatgtttttaaccactatgatattctgcaacaattttctcttccaacctctccccgctgttcatcttatgctctagaagctaacactcacactggcagtcttggtgttttccaggtagctcattcaatcttggggggaaaccttattgtacaaatcatctttttggccctttctacttcatcagtcagaattctttcatttgctttcagctttccaaatatttattgaatttactcatctcttgttattttcccttctgttattttcattttgtttttataatttagacggagtcttagaaaagagagaatataaactcaaatgatcatctgccatcttgatctaaaagggggatactccagacgtagaggagtatgatttacactagagtccatcaggtgtgacttgtgaccagacttaagcctgctttcccaaccttgtctccgacttttgagccccatatgttttaatgtatgtttctagtatatgcttcacatttccctgagtctgagtgcctccctctaatctctaacgctttaagtcctcctgaaagccatagctgaatatgatctctcttcctcagctcaactgctagaggactggtagtacctaaccagtggtgcgtatcatgttttctcttttattataataatttctgttttttttttttgagacagggtcccactgggtggtccaggctggagttcagtggtgtaatctcaccttactgcaacctctacttccccagctcaggtgatctttcccacctcagcctcccacatagctgggactacgggcatgcaccacaacaccttgctaatttttgtatttgtagtagagatggggttttgccgtgttgcccagcctggtctcgaactccttggctcaatcgatcctcctgcttcggcctcccaagaagcttcttatgagtattagcagatccttttgccgtggaaaaagaacattcagtttgaaatcaggtgctgtaacaaaatcgtgacctatatggcattaggttagtatatgggtgtcaggagataaagaattagataataaatgctagaaagcagcctatttatgctatgctgaggtaagctatttagtaagttttgtctacaataactttgaaaaaatactacgtatcttctgcatctgtagtttaggagagcttagaaagagctcacattttagtgtttgttgactgttactgcttttagcaatattgtaagaaaaaatgagttcaggaaggtattggctgattttccagaagaaattaaagctatcaaagtgttagaaaagccaaatacatctagtcctaaaactgtaggagataagactgaaaaagacttagaggcaaaatacatatcaatgcttgtcattaactgaaggaactcagccctatggctaagatcacaacgagaatatagttttcatcttcgcccattatttcactagcatcaaagaagctgccattaagttaaaggcaagtgctcaaaaaataaagagatttaaaactatgtctctgaaataactttgggtgtagtcaggcaaatggagctcagtgaaattgattagaaatcagcaaattgattagaaatcacaggtttctaagggaatcgtattgccaaagtaatcatgagactgacttgaaaagcctttgcctatttcctctctaaaacaaacctagcatcgtaagacaatgtgttgcaaaatctgaacagcttgcagtgagggcacactgcctaacactcacttaaatgtggccatagaattaaatgaccaaggaagtaactttcaaagtgcaaagccaagagccatggtgaacaatgacatttcttctacttcctgggaaggagtcttcacaatgtttgcccagtggattctatcattgccacggacctatgactgatgtgtgtttcacattaatctctcttttgaatggtaatttttattgcccatatcttagcccagctctaccaatgtgttttgggtatggtagtgggcagattactttacttttcttagtttattggttttctggccatgggaaactgcatttcaatctagtgagaaaacagtacatgccccaaaattcttggctttgagctacatgctatcagcttagatccataaatgatgatagaaagaataatcactttccccacaggcctagagtaatattcctgtaccattacctgagaaagaaataaacttcttgtgtgtaaacaaaattatgctttgggacttaaattgccctagttaatactgtatacaatcaattaggtgggataaagtaacaataatctcaggctgtgaaaatactcaaagtcaagtgggtagcagcaaataggctgggtaggtgtggaatcgggagcacatcaaggcttgaggatacagcaaagtatctgcttacaagaatagggctagccaagtgggcagaaaccagacagaagagttaggtttcaagtccagtttttaatcctggtggaggaattgtggggaaagtcattcctagaaatacaaaaaccaacattggtcactttgctttaagaaacttcaaatcatcaagaaaactatttttacttccctgtctgcagaatccttgagaaaaaaactctaggtctgttgtagttttgatttcaaaaggagtaaactggtctatgacataatcacttcggtggactctattctagacacagtgaaggagtgagatgtgaaggtgctctgtcattgcctcagtcaagactttcatggtacattggaagaaagagaagcgtgaacaaattgcatgatacttgaggtcatgctgtgtacctgtattgaacaagaataagggaagaaagctgggaacctggatctcccatatattggaagttttgtaaaaaccttgaggtgagtaaataaaaacaaattcttaaaggtttttcaaaaaacaattgattacatggttatcatgttttagaggattctgtttagctttagaagtgaagagctatatgggtcagagaatgtggcaacttataagttctatatcttttgctcagatggtcccagtgagagatgagggcttcatttgcttttcttttaggttttctttataagttgtcttagtccattctcacgctgccataaagaactgcctgagactgggtagtttataaaggaaataggtgtaattgacttactgttccccatggctggggaggcttcagaaaacttgcagtcaaggcagaagtcacctcttcacagggtggcaggagagagaatgagtgccaagcgaaggggtaagccacttataaaagcatcagatcttgtgagaactcactcactattgtgagaacagcatgagcagcatgagggtaaccaccttcatgattaaattacctcccacagggtcccttccactacatatggggattatgggaactgcaattcaagatgagatttgagtgaggacacagccaaaccacatggtaagtcctggtgggaaccgtggtcattgctatataggatgactattacagttctagaaataaactctttcctagagcagacttattttgagggagaaacaacagaggcacatttttctgccttctgttgctgggagtgcactctcttgttgcttcctcaggtgctaaaatggagaagtagcccgatttttcaaactaggatttgaattatgaattaaaacgtattaatctgatgaaggattatatacacacttgctcttaatattatgtcaaactgatatatttgacatatatatgttttttaaatttaattattaatttatttatttaccttaagttccaggatacatgtgcagaatgtgcaggtttgttacataggtatacatgtgccatggcggtttgctgcccatatcaacccgtcatctaggttttaagccccgtttatatttttattgaggtaaaatatacatatataatttgccatctttaccattttgcatatacacttcagtggtaataaacacaattgtgttctttattttgccttcatcatcccctccctgctctccttcccgtcctctggtgattaccaatctacccaatctactttctgtcttcatgaagtccacatgtttagctcctacatatgagtgagaacacgtgatatttgtctttctaatatgtgttaatattaaaaaaagttttagaaacacttcacatttaaaaagtggaatcacattccttccaaggtatacgaactaagttgtcttattgttgagttaggaaacagatatttctggctttccttccctttgaaacatttctccttcagctttcaaggcttatttctgcagagtcacagcacagtttaaacacaccccaaaaagcatgtttcatgagatatgaacatggggcaataccaagatgtctctggtcttcagttttgaagtagagctctagcttagaaatattcaacagcaaccaggaatgttagtactgcattgtaagtccgtggcactatttcttgaacaaatacaagaagaaagaaactactgagtgttgaagtttttctttttgagctttaaaatttatgcactacatatttttttagttcagaataatcatactatgttttctattttttcattaaaaattcatttctacacatattttcacttgtagacaaagtgtacacgcactttttaattggctacataatagtctattttgttaatatgctaatatgtaaattataactgacacatagacattactaagttagtgaacatttgggttattttctttttgctatttgttgatgcaattaatatgtaaagtcaattacaaaataataatttacacttttttgtaattttactggagcacattcttcaaaatggaaatactgggccaaaaatatatagacaaatttgtgaattttggaatatattgctctattgtttctgagtcaatttacagttactaataatgtataagtattttttcccattatgccttatctaagtcatcaacaaatgcttttgctacattaatacttctatctgtataatggttgtattaagtaaacaagactcatagaattcaattagaaataatttgagtcatggctcctgtgtccttttaaatgtcttctgtagaactggtccttgcattgttcctctgcccaaacatcccattactcttctggtcaccattaggtaatacaaatggctctccagtttgtaattaaaatgtctataccaatgcaataatcaacatttccattctgatttaaaattaatgtttgtatttcttctcttccctggattcaggaaaggaatgatctagtcaacttctccccaaccccaaactggagcatttattccttttcttccatcttgccactcaaagtttctaaaccctccagcactggaacacaggaaggaaaaaactaggtaaaggagtaggaaagtccgactagaccaatatttcacagtggtcccacattttctcttggcagagttttacatttgaaccttcctcttataggtattcttgagagttcttcagaattttcccatcacttgggacttttcatctgatattctcttggcttgtataaatccatgtctgtttcagttgtttgcctgcatccttcttcagtccctcatgggtaaacaaagtattagatgtctggcaacacttctgttttctttctcttaaaagttattggcctctctaggaagtcatttccaacatgacaaaagataactcacaggaacatttttttttttgcagttggtgtgtatagagcccacaggaaactcattttttcactgcctcttaaaactgtaggaatgcttgtcatccctagctttccagtatctccttaatatactttcagggcaggactggggccatttttttgccctttagatatctcaagtaagagtcataattctctgacattccaaggacacattcaagttctcccaagaccctctagagctcttgacaaagtgaagagagaacctcctcacctctcctccttaggagagaccttgaagacacacaaacagctctctacactcccttttgttcagtcaccaactccttacacttttattcttttactgttggtgagagttttagaattgtacaatctttagacatttcctttggaaattctgtattaagtcttatatgtcaacctggaatgcagtctttattggatataaggtgtcagcccgatcatctattttggttttctattactttagctaagactctttctattataaatgacaaaaagcctaatttaaaaaaaccagcttaagcaaagaggggatttattgactcccataactgagaagaggttttgtctgcttaggcacatctggatgcacagctcttcgggacctagctcactttctcattcttcctccattcctctccctctctcctccagctgtccttcatgtgatgactttatgttcagacaggttatgctgatgtatccagcctagtctgctttccatgttaaaaatgatcccaggtggtctatatcactttccagtgttcaaatttggaaccatacgcatactaaatttgataatcagtcagatgatgagcactctcaccttccctttctcatgatttcctggcctggctgtgatacctatacacaagtattttacaccattcttactccaggctgctcagccagttgtcaattttaagatccctcattctatggtcacacttttgacattttaagtgtaggtttaagaacaaatattatcatacctcttaataattaatttcttttcatgggtaaataaggtattaggaaataataagtgtattttaaaaaatgaataatcacaactcagggtacaaaactatgactgtattttttccataattggattttttttttattttctttttctttttttttttttttgagtcggagtcttgctctggcacacaggctggagtgcagtggcacgatcttggctcactgcaacctccgccttccaggttcaaacgattctcctgcctcagcctcctgagcagctaggattacaggtgtgcaccaccatggccagctaatttttgtatttttagtagagatgggatttcaccatgttggccaggctggtctggaacttaggtgatctacccacctcagcttcccagggtgctgggattacaggtgtgagccactgcgctcagctggatttattttctattttgagaacccacctgttgtgtcttttgcagacaagtaatatagtatcttgcaggtaaacttataaaacataactgtgcttatccttttatttttctttctcttgtattaattatggcttaacactaagctctacagctatatacaaattcaatataagcacttttacattctttaaagataaattagggctagttctgaaaagctgcttattttcccatacaaaagcagattttgtatagaatcatgtttgagtcatcttttgctgtaatatacctctttccatcaaaaagcatttgtgcgcttcctccttatggtttaaccttggtttagtttctatgcaaaatttaaaaaaatccaggggctttagtctgagggaaacagttgtggagaatatcactctacacattatatcaacatgtaaataaactagacacttttcaggtttaagaagatacgggagagaattgcaaaagttgcacatgactgccatgaggattatctctcactacatgagagtaaatttttttccttttggactgatattaatagtttcttcttgtttttcatttttctgtataaatatataactcttgtgacatttctgccaggcagttattctaatcttcatatttcagataaagaaaccaaagttatgtgaataaatagtgaggattcaaatcctggctccaaatctgattctctgtccacatcacgccagaccaaacctttaagaggtcactgtgtatcatgccattttaaatattaataaaggcttcatgaaataagaagcaaattttgttaagcctctcaggagttacaaaaatgaattaaagttcttgcttttaatgaatcatagttaagaagggtatggaattcagatcgtagtaatgctacaaaatatgcataagtgctgtgaggattcagaggagatgtttacatctagatgctgaaagtgggttagcagttggcaatgcacatgccccctaaatacagctgagggcataaatgcattagaactggttgacacagtgagaggcctatgcatcactttgggtcaaagtatttatttatttttatttaaataacatttggcttttaggaatttcttctaagaaatttgctacatttgataggatatatgtttagaataaaccagaaggctattcttcaatcactatatatcaatatcaccaaaatacgcctttgtccatgctgttctttggctctccgttcagagttgtttttggagttaaatttctattgcaagaaaaggtcattctttcttcacaatgcctctcagccttctccattcattttttccctcatttagatcttttgctcataacgacacaagcaaacaaccagggctgaagagtacaattccataatcagcatcaccaaaccttcccatcccatccccaattttaagaaatccaacatgagccatccatggggtcatggtatcttcacaggaaagatttctttattacaatattttgctgatttaattataaaaatacaagggaaatggtcatttcttcccccacgaataccaaatttaactatgaaaatttcattgctgattcgaatgtcacctctggaacctttgttgaaatttaattgccattgtaacagtgttgggaggggcctttaaggtcacgattaggtcatgaggactccattctcataaatgtaataacgccttatagagggaatgggcttctgatgaaaggatgtgtttggcttcatttcctctctcttcatcttacgcttttgcttgccttgctgctttgttatcatgcagtaagaaggttctcatcagttacaaggcagatgtcagtgccatgcccttcgccttcccagcctccagaactaggaagaaaataaatttcttttctttttaaattacccagtctgtcgtattctgttatagtagcagaaaattggctaagacattcatatatagaagtacagagaaattgcttggaaaagttcaaggaggtcaaagcagtttgtactttaattattcactaaattctgtagctctggttaagaaggcacattcactctgatctcttcctgtctttgacttgtaaattactttagcaaaaaggttaatctcaccctctcttgtttcaacatgttgcttttattaaaaatgtaaatttaaaattaccttggcatttgggtcattaattggattaattaacctaataatgctcttaaaattacttttaaaaaacatgtatcaacagaaatgttcccttcttagtctcattctctattttaagtagtcaatatagtacaaaaacactctccgaacatacaagtaggttaaaatttagattttttaatttattaaaaggtaaatttctgttaccatgcctgaaaatatgcaaaatagaaaacatttacttggttatcacacaataataaaaagtcatatagatttttattagttcggaaataaagtatcacaggaaggtcttttttgttttttgtttttgctttttaagttttactacaaatgagtgacagctgtatagtcacagtccttagtttctatatctagaaatttcctttaaatggtttaaagcaatttccaaagttttattaataagagaaactgggactggacagattaaagaatttaattgagaaccttatagtaacctattaaaatattcacctgcatgtccggtttgcacatcttgttgaatttagagttgagtttctgttataaagaaaggtcgtaagttcttttccttctccggatactctacttacacaaataactctttcagtggaatgcaagcttcagtgagtgctccgacacagttctactgttagacaaattattttaaatatggcacttatatatatgtaatatttcatattaatgggaaaaccttttgtgttgatttatgcattaaatgataaatgtgtgtgtttgtgtgtgtgtgtgtgtgtgtgtatggcatttctgagcataagctttattagtgtgaacaaaatatagtaatcattcatgtaatattatatcttgcctgttcagcaatgaaggaaatgaatgataggactttagtgtccccttaatttatttaaaacaatgaaaccagactcaaaagtttacaataggaagaaaatctaaacttcatctaggtatttcaagcctttcatttgacagaatcatcattataatacaatagaataggttaagttaatattaaacaaacgtagatgaattcaactaaagttttggatcagaattctcaaacaattctaaaaattatgctaacacacaaaagcaagcattcaaggaaacatttgttctttatcttgaaatattaatgagcagagatttttttccccatcattgagtcactggaactcattataatgaaaattgcattctgaaattgtacaacttaggcaggtatataatttattggagtgtccagtccacatgttaatttttcacttgactgaagtcttatgtcttctttgtgttctttccacatttggtttggtgaacagattctcattgatcacttgtctctagaaggattatagtaaaaaaaatacaagaccgaaatatgagacatagttatgtttaaacacaacaggaaattaatgcacagtatacattttaggattctacattcttgcagagttgttcttgaatgtaattagtaggaaacgaaaggactctccttacatattagctctattgtcaagttttgtgtaaagaaaaatacagaatttcttagaatatctattctaaaagccttaggtaaagaataaatataattgctctgctcctagtttctacagagataagaaacaaacagccaaacttgtatagaggcaaaatataatgtgaagccagtaaatgataagttgaatcacatatgcatgttaaaatttaaggcatgtgtctaagtctgtcatgtctttttaaataatgactttttttttcccccaaggagaagtctgcacaaaagcttatggccaagttcctctctggttctagggtgtaaaagaagggcactgggctagttttctccagtaaacccgatgctccacttttcctggttggaaggttgaatttatgttgctcctagaaactgcatgaaagggagaggggagcccttgctcttccagaagcagagcttttccagccttcttctatttgggcaccacaggaactgtgcatctcaaacattctcctgtgggaaataggctagtgggtcacatatgcatgccacagtggccagctgactcagattcgcttattctcatttttcaccaatcacagatcatgtgcacttttagaaggttaaaacaatttatactctaattactcctttacatcattagttcttgttgagatggtactgtcattttaacctcttatgcctttggcttataaactaatttagagccatattctataaaagtagaaataaagcattttaaataatctttaataatgtgttttcctatgttttctgtgaggtgcagtcagaattcataacttgtctcactaacatactaagacatttaataacttcacttgcacaaatgtggggaaataaagtgagcctaaagtttggttcttctgactttccactgccattacacatatttgagatgtgaacagagaaccaaagcagcaatcctgctaatgtggaaatgcatacaattctttaagtaaacatattctgtcttccatgcttttactcactcaggctgcccttctgctaaaactaccctgccctagctaatatctatctgtcttttaaggctaatcccaggtgatttcatcttcagaagcctttgatacctgtctcagtctctgggacaagtggagctattgcctccactactgtagaacttgttcactgcaatgacattctgttttttccattagtctctcagcttctaaaggacgaagactcatattggtatatctaatgtgagtgtggtgcctaccccactgtatgcatttagcaaatgtttgttgcacttaactgaattaaactacaaggacatcttgatgcactgtggcgtattaaattgtgccaaacatttgagatgcttaaaattgtatgaaaaaaatggcaggggaaactctaaacaataaatttgtctctagaataaataagtagctaaaaatgtatataaatttcagttcgaaaaataggctttaggttgtaattgctccacttgaaaaactacatcaagacttttttgtggaacaaggcagaatgcagataaaatgaatattttacagatacttgttccagctgccagtccaataacaagataaccttagtaaatgaagtgaatctggcatatgactcaaaaacttccgttgtttcaagtatctgcagattggattttattaatccttttagctgagaatcatatctatgccattcatttccacatagcaggaatgtcttaggattataaacttatgtaacaattactcttaagctttaagaattcacatgataatgtgatgtggcaaatcctgcatataacctgtgtagctgtgatggatcttgaaaactctgtgttctgtgactctaaagtctagaaaacctagactggcccagggttaaaatcgaaatccagaagcatacaggacctctgatctgtcatgatttctgaaaattatgggagtaaaatcagttgattttgtagaaggcagaatgaaatctcttttgcttgagaaataaagctcattccagagacttgttcttagtaactatctcccaaaatagatgtcatttgggtttatgcttcaggcaaagtttaatagaaactatatgctttcttagtgagttcataccaggggccacggtgaataaaacaaatgcaattggctagggatttagacagacagtacaggtagcagccactactcagctcttaggaattggtctcatgctggtatgaaggctctcagcattttgggagtttacatttttccccagaggaatagcaatacttgatttttaaaatgtaacaatttccgacttttaaaggttgacaataaatattcttttcaaaaagcactatgtggtttaatactgttctggataaacaaaatatatccatggcctttcacatgttttgtatctgcttagcacctgggagtggagatgaaagcatgtgccagatggcttgccagtgtgcacaggaggtcatttgggaatgacactatattgataacatgctatattgatatagcattgatgtcagtgctatattgataacagctaacaggcatgaggacttatgatggccacaaatggttttaaatgctttaccggttgtagctcatttaattctcattaaactttgtgaggttgatactatcattatccccatattaaaagaggtttagtagcttgctcagggttacacagctaataggtgttggagcatggattcaaatccaagtctgatttcagatctggggctaattcactatgctacaccatactgaccatagagtctcctatacacataactttgcagtttgggaaatacgaagtacacttggttttctcttttgcttttactatttgattgagtttttttttttttgttaaaaaaacaaaacaaaacaaaacactttgtgtccaaaggagaatctcactatgctgcagacatttctaaaaagtcaaagaagtagaattaatgagatagaatagaaatgaatcataactggttccctcctccctcaaatcagaaagaagtaactcactggtttgatttttttttcctaaaaggcaaaaggaactgcaaatattaacaccaacctggattttctatttcaacagaacttaaaggcacgtctgtgtcaggtgaggggagaggttttacatcagatgggcttttctatgaagaaataccataaaatattaataacacaattttctagtcttaagacagtaaaaagtaaaatgcttcagcttaaaaatatttttttctaaaattttttttcttttggttgaaatcccctttgcagagattttgttattgttgttgttactagttactggtataagcattgatttaaacttgtatttgtgttcctctatagtatttggtatttcagtaggagaaatatcacctcaaacactgatacttacatatttccctgctgtaataaatagtgaaagtgaaaataaaaataaaaataaagtgtgtgatctctgcatcatgttgaccaggacaaaattcatccatatacacttagaaaattctctgaactttgccaactaaatatttccttggctttttcaggttttagaacattgacgaagagagaagacaacccactttgccatatatgcccatgtaagaagatgacttttctcttttatactccaggcaaaaaaagctatcttatattaaagtccttacaaaatatctcacacaagagtaggcattttcagttacttttctttgattaacaaaaagtattatttaaggaagatatatttacatggaatactgaaaatcaattataggattggatgatggtagaagttaactgttagaagtagttaaaaaagaaaagaggcaaaggaacttaatgtagatattactatcatatcttctgatggccccacaattgcagtgctgtcacacctctcagcctttttaaaagaattatatagtggttatggtctcaaaaatcacaaagagagattaagaatagaggatgaatgaaaacacaactgtaccaatctcatgtgactaagtacttctgatctaggattacagagacagtgacagcatcataaatacacacacacatattatgtcttaaatatcgtgaatagaaagtgatagcaaaagttatgcacttcgataagctgtgttgtatggatgtaaaaatagcattagtgggctgggcgtggtggctcatgcttgtaatcccagcactttggaggccaagggcagatggatcacttgaggtcaggagtttgaaaccagcctggccaacacagcgaaaccccatctctgctattaaaaaaatacaaaaattagtcaggcatggtgtcccgcacctgtagtcccaactactgcggaggctgaagcacgagaatcacttaaaccagggaggcagaggctgcagtgagcagagattgcaccactttgcactcgagcctgggtgacagagggaaactcttgtctcaaaaaaaaaaaaaaaaattaaaaaaagcattaatgattcaaaaaaaatcactgatgttaagaattcatgggtggaaatttgaaaaatctgtttcagaatatgtgagaattaagaaaggcaaaagttttattttgtttatttttatttatttatttatataattattgagacagggtctcactctgttgcccaggctggagtgcagtagcatgatcacagctcactgcagccttgatttcccaggctcaagcaatcctcccacttcagccccctgagtagctgatactacacatgtgcaccaccacgcctttctaattttcatattttttgtatagactaggtttcacctttttgctcaggctggtctcaaactcctgagctcaagcaatcctcctgccttggcttccctcaaagttttaaacatatgtaaatatattattttaaatattttatacactaatagggtaaatactataagtagaatcttaatatttcctcaatatccatcaaaatatgtgacagcaagttagacaaaaacttagggagatctttcattgggaaaatgggggacagatttatatttagaggttccctttaattgggcaaatgcaaagaaaaattctgctagagaaacacagtgacttctatgtgtccagttgaaaaatatggaattttatgcagttctgtttctcttttgagtttaactgaactcagaggaataaaccctcttagagctgttcacattggtatttacagcaaaattaaaaactgaattctcacctttatcagtcggcgaataccgtaagaaattaagaggatcgttccaataacaccagccatcaccccaaaaataatgagtgttatctctacaggagataaagagagcagcaaaattatgaaagtctgaaataaatgaccatatagcaactgaaaaataagacagataacatcagcataccatcaccttgccttttaatagaaagcacaattaatatactattatgtagattttgtctttttttaaattgtgtgctttacagtaaccttgtgggaaactgggactgtgagtgatcaagtcttttgtccaaggtcgcaaaatagttgatgacagaactaagacctgaagcttctgattccagacccagcgttcttcactagtgtaactgtagataagaactcagtggacgttctcctcagatatggggaaaaaaccacaaattctcccatagtttggaagttatgagagaaaataatgtcttaatgtataaaagagcattgaacagatcatagaatcataattttggaaagaaactggtataaacagtttacaaatgaagaaaagaagctgaataaggttaacttagccttggtcagacaactagttaaaagtagaattataattataatgcaggtcatctatgttctaagctttattccttccatagtattcttatgcatagtctccaatgtagtcactaaaaatgcttgttgagtcatttatatgttgggaatgaaacaattgaaatcaattaagagatatttccatatttatagcatatttgtagtgcttccagttgaagtaaatagaatggaaggctagacataaaggtaaaatggctcatttatttgcctaattaatatttaaaagccctattgttgataaaaagtaaaagtagcatttcctcttgctggtgttgcccagccttcttgaccacttagcttgaatgtatgcgatagtgatgaagttctatgatgtgctttttaccctgtgagccgtggacacagccaagtgtgaagggagggttggaatgcagaatagcaaatgagcacacacagtgatactcaagtgaggggaagggatgtcccttcagcagaggttgtcaagatggtccctaagtggttgcattgggccaaaaatgaatcaaggctgagatttacccttgaaatacagtaccagttaattagatgattttaaatgccttgctttttatatgagggaagttcatttgttttataagctcttatgaggcttttttcaagtactcaggcttggttagaaaggtaaaacatctaacttaagagaaaaactattaccaaattatgtatttctatttccaaaatgtttttatttatttttatttacttatgtatttgtttttgagacagggtcttaccaaggctagagtacagtggcacagtcatagctcactgcagccttaaactcccagactcaggcaatggatccgatcctcccacctcagccagcctcccaagtagctgagactacaggtgcgtgccccatgccagctaatttttgtattttttgtagagatggatttcgccatattgcccaggctgttctcaaattcctgggctcaagcgattagccaggctcagcctcccaaagttctgggattataggcatgagccacggcccctggcccccaaaatgtttttaaaaataagaaatgcctattttaattttaaaaagagaatattttctttgcctttacaattttgtgtgaataaagttaacaacatatgctcttctaagatagacacattttcttaggcatttgaaacaagcaatggatagtttaaaatggaatgacttttattctttgtcaaatattaacatacctggttcagagaaatgatgggcaagttgtaccctttctcctataaagcaaaatttcaatgtaagtccaaataagtaaggcatgtgcaaagaaaaaaatcattttggaatcaaactgttctgtgggtttccttttcttaatcatattttgagagttgttggtcaactttcaacatctagctagtaacatttatgaggtaatatgtcagtcgtaccattagtaatttcagtatctacttttaatgacccaacaagtattcatggatgagaaataagcaaattgtctcataactgagggggaaggaatgagaaagtattggaagaatcacttattgacttccacaagaagcaatgcatttttaaaaaatttaaaaataaggagaagaaaggaggcatatggaaccattactccacacagatgccagtcccatgcaaagagggatcatgcgactatcaattttctgatttatgccacagccactgtctgaatctaaactgttactgtgtctcatttgagcttttgccaatagtctctctggattctatgtcagcagcaattgatagtatggttgccttactgttccacctgtgctaaccttccctctcagtccacatcctacttttgtctctgtctccacttgccattttacatcatgaagctctcttactaccgaagccacacaattttctagagtttaattattacaaattacttagtatatactatgctgtttgatgattgaggattcaggtatattttttcattctttaggctttacgtacaaaggttaattggggcttgccttctctttcttggtcacagttaatagttgtgggtgctatatgggctttggagtaaaagagatgggttttctgtcacgaaagcttgagaactgtcatgagttacagctcgtgtaaatagagttcaatcacaacaatgactccagagcaactatttaaaactaagaacataccggtttcctcttctggagggtaaacagttctaacagaaatttctgaaacttcatgagctctaggagtggctgcatatgtgtcccgtttgtgcgtatctgcatataagagaagttgagaaagggcacaagaatgaggtgactgcgtggacatagagcgtattatgaaagacaaactctcccacatccctcccagcagcggctccagaatttcttcttctcccctgaaaactaacaagagagactgccaccagattactcttatctcagcacccagctttgcttattgtttatcagtcactgagaatgtgtgaggctctgagctaataacttttagatacatcttcttatttagcctttagagaaatgctgtgagataagtactgtgttattggccccattttaaaattaatgggatagaaaccctgcagggcaactcaccctgggtcagcagctggcatagagctgagcccgggtctgagctgaactcagtttgcccacagaccctccgcaccaccgcactattaggtcccctttatctggcccactatttcatggtcacgtgcatcatttctgtgctttgccacattgttttaatttctttaactcacagtattatttctgtgagatatttcagaggcaagaattcctccatagtaggaattgtgtctacttagtaggctgtgtctacttagctcgcatttctcagtgtttgtcagtttctctgcagtgacaggtcccctaaaatgggttacatcacaaaaatgatttcggagccacaatttaaaaataaaaatgaaaacaaaccatttgtctgtgatgagatgtaactctttgtgactgaagaagaagttgaagtgtgcattgccacctcagtggtacttaatgctgatatgctcacaatttctgtataaaatagaagttgagaaagggattaagaacgaggtgactgagcggaccataaagcatattgcaaaagacaaattccctcacatccctccagtccctgagctaagcgctttggtatatatcttacataatgtttagagaattgctatgtggtaagtattgtattattggccttattttaaaattaaggggccagaagcccctccagaatttctgcatagcagaggtttacagataaagcgtgccttggttttctcatctgtacaataataatacttgcctcaaaatgtcattgtgagaacgaaattagtttaaatatgtgtgtgtatgtggtgtgtgtgtatgtaatgtgcatgtgttagtatagtacttggcacataaagagcattacatatatgttgggtattattgttattatgcttataaaggggtaacttgaagttgcattttggaaactgtctatgctaagaaaggtggaagcgcataataattatatagaacaaaacttctgtcccatatctcagtgtctccatctgctagggacaatcttacttcttcaataaaaatggaaacaataataaaacactattacattgtgtgaacccaggaggcaaagcttgcagtgagccgagatcacgccactgcactccagcctgggcgacagagcgagactctgtctcaaaagaaaaaaaaaaccatgcatgcaaacatgaaatcagaatgtagactcacatatatccttttaaaatctcattaaataaattgtgaattatttttgtaattaaacactttttattcttaaatgcaatacatttcaaatttataagttattttataaaattttataaattaaattctttaaattgcaaaagtaatatagattcagtaaagaaaatttgggaactacaagaaagcacaaagaataatataaaattcatctacagtcagcctatgcaaggttgaacatttgacacattttgatatatagccatctgaacttttagttgttatatctaaatatgggatcatggtgtttaaatatacgtgaatatgtatataatgtttacaagtctgactttctacttaatatgccacagatatccctatgctgtcaaatattcttctatgagaagatttttatgactgcagagtattccattgtatgaatgttctgtggtttatatttcaatctcctattctgtgcattcatgtgtttttcactcttctgagagttataaatcattatgataaaagtcagtaccctgaactctgtagatgtacatttgctcatctcttggagatattcaactgaggggaatggcacccaagtgcaatggagtggaggtggaagggcttcttctcagaggcagccaacttggcccctcagctgaatgctcaaagtttcctggagaacccacaaacaacagaaaacatcttctctgacacctctcattagtctacccaactgaagacttctaaaaccttcctctatttatcagctgataggtaatcagtttacctccaaatcatggagaagacatgatctattgttcctaaactgtctattttttctcttctcttttaagttcttttctggccttgctctttaacttggcctgccacctgattccatcatgtatgtataaacgattgccatatgaattcactaaatagcatgcaaaacaattactgaatgtttctaagttgttcagcactcaggtataatggcttttaagataatataaaaaccaatgcttttaaacaataacctggtgatagggattttgaagttcaacaaatattaagattaaaattacagaaagaaacatctttatgagtcaactaaagtacgtaaaaattatttataaagataactaatgaacaaaaataatccatctctcttaataaatgttagatatgagctttggcttatttctagataatggaatatggaccttctattgtatttttgaaaaggcatacaatctgagtaaaataggtttagctatgaaagtgttgtgaaaatagctagtaaaacaacaagccaaaaaaaatcaaaagtgttaatggccagaagccttaaatgggcatgtaacaataaacttgagatcagcctttggctcagcaacatgggaatacaactggaaaatgcagctggagctctcatccttcactcaggtgtgctcgtcacttccatttctaactttcatcctctccaagcttctccctttaatcttccactccttctttacacctttcagttcagtgtaatccacttacatttagggtgcacatttcttagccctgtggataccaaatgggctcttctgaaacataaaacttgttcctaggacttcaatttcccattattttgaatcttctcagcatgagaatagtgctttattcataaaagatgttaaatgaaatgctaattgttataaatgcttggacaaattcttacgtagaaagaattaggtgagtggtatggtttggatctgtggcatcatccaaatctcatggggaaatgtaatccccaatgttggaagtggggactggtgggtggtaattgaatcatggggctggtttctcattgcttaacatcatcccccttgatgctgtctgggagatagtgatttctcataagatctggttgtttaaaagtgtgtggcacctccccactctctcttgctcctgctccaaggctctctctccccactctctctcttgctcttgttccaaccatgtaagacgtgcctactttcccttcgtcttttgccatgattgtttcctgaggcctccccagaagcagaagcactatgcttcttgtatagcctgcagaaccatgaggcaattaaacctcttttattttattttattttattttattttattttattttattttattttattttattattattatactttaagtttttgggtacctgtgcacaatgtgcaggttagttacatatgtatacatgtgccatgctggtgtgctgcacccattaactcgtcatttagcattaggtatatctcctaatgctatccctcccccctccccccaccccacaacagtctccagagtgtgatgttccccttcctgtgtccatgtgttctcactgttcaattcccacctatgagtgagaatatgcggtgtttggttttttgttcttgcgacagtttactgagaatgatgatttccaatttcatccctgttcctacaaaggacatgaactcatcattttttatggctgcatagtattccatggtgtatatttgccacattttcttaatccagtctatcattgttggacatttggattggttccaagtctttgatattatgaatagtgccgcaataaacatacacgtccatgtgtctttatagcagcatgatttatagtcctttgggtatatacccagtaatgggatggctgggtcaaatggaacctcttttctttataaattacccagtatcagttatttctttatagcagtgtgagaacaaatgggttttcagattgcatctgaatgtgaatataataatttaagtaattaataaatttaacttaattataacacataattaattataaattaatcaatttataattaatatatttaattaatacaattgtttaataaattaagcaaaccacatgacaaaatagcacatgcagaatgaatgcaagcatctggaaaaataagcatcattttaagaccaatgaaatattttcaacatttcaatagcgagcatacttttgctaacataagaaaaaaaaaacaaaaagtaaaaaataaaaatacacaaaacgtagtctgtaaatgccatctagtggttttgactatgagtacaaatatacatattcctccaagttgcct

SEQ ID NO: 684 - DNA, 13150 bp, Homo sapiens
aaactgtaggagataagactgaaaaagacttagaggcaaaatacatatcaatgcttgtcattaactgaaggaactcagccctatggctaagatcacaacgagaatatagttttcatcttcgcccattatttcactagcatcaaagaagctgccattaagttaaaggcaagtgctcaaaaaataaagagatttaaaactatgtctctgaaataactttgggtgtagtcaggcaaatggagctcagtgaaattgattagaaatcagcaaattgattagaaatcacaggtttctaagggaatcgtattgccaaagtaatcatgagactgacttgaaaagcctttgcctatttcctctctaaaacaaacctagcatcgtaagacaatgtgttgcaaaatctgaacagcttgcagtgagggcacactgcctaacactcacttaaatgtggccatagaattaaatgaccaaggaagtaactttcaaagtgcaaagccaagagccatggtgaacaatgacatttcttctacttcctgggaaggagtcttcacaatgtttgcccagtggattctatcattgccacggacctatgactgatgtgtgtttcacattaatctctcttttgaatggtaatttttattgcccatatcttagcccagctctaccaatgtgttttgggtatggtagtgggcagattactttacttttcttagtttattggttttctggccatgggaaactgcatttcaatctagtgagaaaacagtacatgccccaaaattcttggctttgagctacatgctatcagcttagatccataaatgatgatagaaagaataatcactttccccacaggcctagagtaatattcctgtaccattacctgagaaagaaataaacttcttgtgtgtaaacaaaattatgctttgggacttaaattgccctagttaatactgtatacaatcaattaggtgggataaagtaacaataatctcaggctgtgaaaatactcaaagtcaagtgggtagcagcaaataggctgggtaggtgtggaatcgggagcacatcaaggcttgaggatacagcaaagtatctgcttacaagaatagggctagccaagtgggcagaaaccagacagaagagttaggtttcaagtccagtttttaatcctggtggaggaattgtggggaaagtcattcctagaaatacaaaaaccaacattggtcactttgctttaagaaacttcaaatcatcaagaaaactatttttacttccctgtctgcagaatccttgagaaaaaaactctaggtctgttgtagttttgatttcaaaaggagtaaactggtctatgacataatcacttcggtggactctattctagacacagtgaaggagtgagatgtgaaggtgctctgtcattgcctcagtcaagactttcatggtacattggaagaaagagaagcgtgaacaaattgcatgatacttgaggtcatgctgtgtacctgtattgaacaagaataagggaagaaagctgggaacctggatctcccatatattggaagttttgtaaaaaccttgaggtgagtaaataaaaacaaattcttaaaggtttttcaaaaaacaattgattacatggttatcatgttttagaggattctgtttagctttagaagtgaagagctatatgggtcagagaatgtggcaacttataagttctatatcttttgctcagatggtcccagtgagagatgagggcttcatttgcttttcttttaggttttctttataagttgtcttagtccattctcacgctgccataaagaactgcctgagactgggtagtttataaaggaaataggtgtaattgacttactgttccccatggctggggaggcttcagaaaacttgcagtcaaggcagaagtcacctcttcacagggtggcaggagagagaatgagtgccaagcgaaggggtaagccacttataaaagcatcagatcttgtgagaactcactcactattgtgagaacagcatgagcagcatgagggtaaccaccttcatgattaaattacctcccacagggtcccttccactacatatggggattatgggaactgcaattcaagatgagatttgagtgaggacacagccaaaccacatggtaagtcctggtgggaaccgtggtcattgctatataggatgactattacagttctagaaataaactctttcctagagcagacttattttgagggagaaacaacagaggcacatttttctgccttctgttgctgggagtgcactctcttgttgcttcctcaggtgctaaaatggagaagtagcccgatttttcaaactaggatttgaattatgaattaaaacgtattaatctgatgaaggattatatacacacttgctcttaatattatgtcaaactgatatatttgacatatatatgttttttaaatttaattattaatttatttatttaccttaagttccaggatacatgtgcagaatgtgcaggtttgttacataggtatacatgtgccatggcggtttgctgcccatatcaacccgtcatctaggttttaagccccgtttatatttttattgaggtaaaatatacatatataatttgccatctttaccattttgcatatacacttcagtggtaataaacacaattgtgttctttattttgccttcatcatcccctccctgctctccttcccgtcctctggtgattaccaatctacccaatctactttctgtcttcatgaagtccacatgtttagctcctacatatgagtgagaacacgtgatatttgtctttctaatatgtgttaatattaaaaaaagttttagaaacacttcacatttaaaaagtggaatcacattccttccaaggtatacgaactaagttgtcttattgttgagttaggaaacagatatttctggctttccttccctttgaaacatttctccttcagctttcaaggcttatttctgcagagtcacagcacagtttaaacacaccccaaaaagcatgtttcatgagatatgaacatggggcaataccaagatgtctctggtcttcagttttgaagtagagctctagcttagaaatattcaacagcaaccaggaatgttagtactgcattgtaagtccgtggcactatttcttgaacaaatacaagaagaaagaaactactgagtgttgaagtttttctttttgagctttaaaatttatgcactacatatttttttagttcagaataatcatactatgttttctattttttcattaaaaattcatttctacacatattttcacttgtagacaaagtgtacacgcactttttaattggctacataatagtctattttgttaatatgctaatatgtaaattataactgacacatagacattactaagttagtgaacatttgggttattttctttttgctatttgttgatgcaattaatatgtaaagtcaattacaaaataataatttacacttttttgtaattttactggagcacattcttcaaaatggaaatactgggccaaaaatatatagacaaatttgtgaattttggaatatattgctctattgtttctgagtcaatttacagttactaataatgtataagtattttttcccattatgccttatctaagtcatcaacaaatgcttttgctacattaatacttctatctgtataatggttgtattaagtaaacaagactcatagaattcaattagaaataatttgagtcatggctcctgtgtccttttaaatgtcttctgtagaactggtccttgcattgttcctctgcccaaacatcccattactcttctggtcaccattaggtaatacaaatggctctccagtttgtaattaaaatgtctataccaatgcaataatcaacatttccattctgatttaaaattaatgtttgtatttcttctcttccctggattcaggaaaggaatgatctagtcaacttctccccaaccccaaactggagcatttattccttttcttccatcttgccactcaaagtttctaaaccctccagcactggaacacaggaaggaaaaaactaggtaaaggagtaggaaagtccgactagaccaatatttcacagtggtcccacattttctcttggcagagttttacatttgaaccttcctcttataggtattcttgagagttcttcagaattttcccatcacttgggacttttcatctgatattctcttggcttgtataaatccatgtctgtttcagttgtttgcctgcatccttcttcagtccctcatgggtaaacaaagtattagatgtctggcaacacttctgttttctttctcttaaaagttattggcctctctaggaagtcatttccaacatgacaaaagataactcacaggaacatttttttttttgcagttggtgtgtatagagcccacaggaaactcattttttcactgcctcttaaaactgtaggaatgcttgtcatccctagctttccagtatctccttaatatactttcagggcaggactggggccatttttttgccctttagatatctcaagtaagagtcataattctctgacattccaaggacacattcaagttctcccaagaccctctagagctcttgacaaagtgaagagagaacctcctcacctctcctccttaggagagaccttgaagacacacaaacagctctctacactcccttttgttcagtcaccaactccttacacttttattcttttactgttggtgagagttttagaattgtacaatctttagacatttcctttggaaattctgtattaagtcttatatgtcaacctggaatgcagtctttattggatataaggtgtcagcccgatcatctattttggttttctattactttagctaagactctttctattataaatgacaaaaagcctaatttaaaaaaaccagcttaagcaaagaggggatttattgactcccataactgagaagaggttttgtctgcttaggcacatctggatgcacagctcttcgggacctagctcactttctcattcttcctccattcctctccctctctcctccagctgtccttcatgtgatgactttatgttcagacaggttatgctgatgtatccagcctagtctgctttccatgttaaaaatgatcccaggtggtctatatcactttccagtgttcaaatttggaaccatacgcatactaaatttgataatcagtcagatgatgagcactctcaccttccctttctcatgatttcctggcctggctgtgatacctatacacaagtattttacaccattcttactccaggctgctcagccagttgtcaattttaagatccctcattctatggtcacacttttgacattttaagtgtaggtttaagaacaaatattatcatacctcttaataattaatttcttttcatgggtaaataaggtattaggaaataataagtgtattttaaaaaatgaataatcacaactcagggtacaaaactatgactgtattttttccataattggattttttttttattttctttttctttttttttttttttgagtcggagtcttgctctggcacacaggctggagtgcagtggcacgatcttggctcactgcaacctccgccttccaggttcaaacgattctcctgcctcagcctcctgagcagctaggattacaggtgtgcaccaccatggccagctaatttttgtatttttagtagagatgggatttcaccatgttggccaggctggtctggaacttaggtgatctacccacctcagcttcccagggtgctgggattacaggtgtgagccactgcgctcagctggatttattttctattttgagaacccacctgttgtgtcttttgcagacaagtaatatagtatcttgcaggtaaacttataaaacataactgtgcttatccttttatttttctttctcttgtattaattatggcttaacactaagctctacagctatatacaaattcaatataagcacttttacattctttaaagataaattagggctagttctgaaaagctgcttattttcccatacaaaagcagattttgtatagaatcatgtttgagtcatcttttgctgtaatatacctctttccatcaaaaagcatttgtgcgcttcctccttatggtttaaccttggtttagtttctatgcaaaatttaaaaaaatccaggggctttagtctgagggaaacagttgtggagaatatcactctacacattatatcaacatgtaaataaactagacacttttcaggtttaagaagatacgggagagaattgcaaaagttgcacatgactgccatgaggattatctctcactacatgagagtaaatttttttccttttggactgatattaatagtttcttcttgtttttcatttttctgtataaatatataactcttgtgacatttctgccaggcagttattctaatcttcatatttcagataaagaaaccaaagttatgtgaataaatagtgaggattcaaatcctggctccaaatctgattctctgtccacatcacgccagaccaaacctttaagaggtcactgtgtatcatgccattttaaatattaataaaggcttcatgaaataagaagcaaattttgttaagcctctcaggagttacaaaaatgaattaaagttcttgcttttaatgaatcatagttaagaagggtatggaattcagatcgtagtaatgctacaaaatatgcataagtgctgtgaggattcagaggagatgtttacatctagatgctgaaagtgggttagcagttggcaatgcacatgccccctaaatacagctgagggcataaatgcattagaactggttgacacagtgagaggcctatgcatcactttgggtcaaagtatttatttatttttatttaaataacatttggcttttaggaatttcttctaagaaatttgctacatttgataggatatatgtttagaataaaccagaaggctattcttcaatcactatatatcaatatcaccaaaatacgcctttgtccatgctgttctttggctctccgttcagagttgtttttggagttaaatttctattgcaagaaaaggtcattctttcttcacaatgcctctcagccttctccattcattttttccctcatttagatcttttgctcataacgacacaagcaaacaaccagggctgaagagtacaattccataatcagcatcaccaaaccttcccatcccatccccaattttaagaaatccaacatgagccatccatggggtcatggtatcttcacaggaaagatttctttattacaatattttgctgatttaattataaaaatacaagggaaatggtcatttcttcccccacgaataccaaatttaactatgaaaatttcattgctgattcgaatgtcacctctggaacctttgttgaaatttaattgccattgtaacagtgttgggaggggcctttaaggtcacgattaggtcatgaggactccattctcataaatgtaataacgccttatagagggaatgggcttctgatgaaaggatgtgtttggcttcatttcctctctcttcatcttacgcttttgcttgccttgctgctttgttatcatgcagtaagaaggttctcatcagttacaaggcagatgtcagtgccatgcccttcgccttcccagcctccagaactaggaagaaaataaatttcttttctttttaaattacccagtctgtcgtattctgttatagtagcagaaaattggctaagacattcatatatagaagtacagagaaattgcttggaaaagttcaaggaggtcaaagcagtttgtactttaattattcactaaattctgtagctctggttaagaaggcacattcactctgatctcttcctgtctttgacttgtaaattactttagcaaaaaggttaatctcaccctctcttgtttcaacatgttgcttttattaaaaatgtaaatttaaaattaccttggcatttgggtcattaattggattaattaacctaataatgctcttaaaattacttttaaaaaacatgtatcaacagaaatgttcccttcttagtctcattctctattttaagtagtcaatatagtacaaaaacactctccgaacatacaagtaggttaaaatttagattttttaatttattaaaaggtaaatttctgttaccatgcctgaaaatatgcaaaatagaaaacatttacttggttatcacacaataataaaaagtcatatagatttttattagttcggaaataaagtatcacaggaaggtcttttttgttttttgtttttgctttttaagttttactacaaatgagtgacagctgtatagtcacagtccttagtttctatatctagaaatttcctttaaatggtttaaagcaatttccaaagttttattaataagagaaactgggactggacagattaaagaatttaattgagaaccttatagtaacctattaaaatattcacctgcatgtccggtttgcacatcttgttgaatttagagttgagtttctgttataaagaaaggtcgtaagttcttttccttctccggatactctacttacacaaataactctttcagtggaatgcaagcttcagtgagtgctccgacacagttctactgttagacaaattattttaaatatggcacttatatatatgtaatatttcatattaatgggaaaaccttttgtgttgatttatgcattaaatgataaatgtgtgtgtttgtgtgtgtgtgtgtgtgtgtgtatggcatttctgagcataagctttattagtgtgaacaaaatatagtaatcattcatgtaatattatatcttgcctgttcagcaatgaaggaaatgaatgataggactttagtgtccccttaatttatttaaaacaatgaaaccagactcaaaagtttacaataggaagaaaatctaaacttcatctaggtatttcaagcctttcatttgacagaatcatcattataatacaatagaataggttaagttaatattaaacaaacgtagatgaattcaactaaagttttggatcagaattctcaaacaattctaaaaattatgctaacacacaaaagcaagcattcaaggaaacatttgttctttatcttgaaatattaatgagcagagatttttttccccatcattgagtcactggaactcattataatgaaaattgcattctgaaattgtacaacttaggcaggtatataatttattggagtgtccagtccacatgttaatttttcacttgactgaagtcttatgtcttctttgtgttctttccacatttggtttggtgaacagattctcattgatcacttgtctctagaaggattatagtaaaaaaaatacaagaccgaaatatgagacatagttatgtttaaacacaacaggaaattaatgcacagtatacattttaggattctacattcttgcagagttgttcttgaatgtaattagtaggaaacgaaaggactctccttacatattagctctattgtcaagttttgtgtaaagaaaaatacagaatttcttagaatatctattctaaaagccttaggtaaagaataaatataattgctctgctcctagtttctacagagataagaaacaaacagccaaacttgtatagaggcaaaatataatgtgaagccagtaaatgataagttgaatcacatatgcatgttaaaatttaaggcatgtgtctaagtctgtcatgtctttttaaataatgactttttttttcccccaaggagaagtctgcacaaaagcttatggccaagttcctctctggttctagggtgtaaaagaagggcactgggctagttttctccagtaaacccgatgctccacttttcctggttggaaggttgaatttatgttgctcctagaaactgcatgaaagggagaggggagcccttgctcttccagaagcagagcttttccagccttcttctatttgggcaccacaggaactgtgcatctcaaacattctcctgtgggaaataggctagtgggtcacatatgcatgccacagtggccagctgactcagattcgcttattctcatttttcaccaatcacagatcatgtgcacttttagaaggttaaaacaatttatactctaattactcctttacatcattagttcttgttgagatggtactgtcattttaacctcttatgcctttggcttataaactaatttagagccatattctataaaagtagaaataaagcattttaaataatctttaataatgtgttttcctatgttttctgtgaggtgcagtcagaattcataacttgtctcactaacatactaagacatttaataacttcacttgcacaaatgtggggaaataaagtgagcctaaagtttggttcttctgactttccactgccattacacatatttgagatgtgaacagagaaccaaagcagcaatcctgctaatgtggaaatgcatacaattctttaagtaaacatattctgtcttccatgcttttactcactcaggctgcccttctgctaaaactaccctgccctagctaatatctatctgtcttttaaggctaatcccaggtgatttcatcttcagaagcctttgatacctgtctcagtctctgggacaagtggagctattgcctccactactgtagaacttgttcactgcaatgacattctgttttttccattagtctctcagcttctaaaggacgaagactcatattggtatatctaatgtgagtgtggtgcctaccccactgtatgcatttagcaaatgtttgttgcacttaactgaattaaactacaaggacatcttgatgcactgtggcgtattaaattgtgccaaacatttgagatgcttaaaattgtatgaaaaaaatggcaggggaaactctaaacaataaatttgtctctagaataaataagtagctaaaaatgtatataaatttcagttcgaaaaataggctttaggttgtaattgctccacttgaaaaactacatcaagacttttttgtggaacaaggcagaatgcagataaaatgaatattttacagatacttgttccagctgccagtccaataacaagataaccttagtaaatgaagtgaatctggcatatgactcaaaaacttccgttgtttcaagtatctgcagattggattttattaatccttttagctgagaatcatatctatgccattcatttccacatagcaggaatgtcttaggattataaacttatgtaacaattactcttaagctttaagaattcacatgataatgtgatgtggcaaatcctgcatataacctgtgtagctgtgatggatcttgaaaactctgtgttctgtgactctaaagtctagaaaacctagactggcccagggttaaaatcgaaatccagaagcatacaggacctctgatctgtcatgatttctgaaaattatgggagtaaaatcagttgattttgtagaaggcagaatgaaatctcttttgcttgagaaataaagctcattccagagacttgttcttagtaactatctcccaaaatagatgtcatttgggtttatgcttcaggcaaagtttaatagaaactatatgctttcttagtgagttcataccaggggccacggtgaataaaacaaatgcaattggctagggatttagacagacagtacaggtagcagccactactcagctcttaggaattggtctcatgctggtatgaaggctctcagcattttgggagtttacatttttccccagaggaatagcaatacttgatttttaaaatgtaacaatttccgacttttaaaggttgacaataaatattcttttcaaaaagcactatgtggtttaatactgttctggataaacaaaatatatccatggcctttcacatgttttgtatctgcttagcacctgggagtggagatgaaagcatgtgccagatggcttgccagtgtgcacaggaggtcatttgggaatgacactatattgataacatgctatattgatatagcattgatgtcagtgctatattgataacagctaacaggcatgaggacttatgatggccacaaatggttttaaatgctttaccggttgtagctcatttaattctcattaaactttgtgaggttgatactatcattatccccatattaaaagaggtttagtagcttgctcagggttacacagctaataggtgttggagcatggattcaaatccaagtctgatttcagatctggggctaattcactatgctacaccatactgaccatagagtctcctatacacataactttgcagtttgggaaatacgaagtacacttggttttctcttttgcttttactatttgattgagtttttttttttttgttaaaaaaacaaaacaaaacaaaacactttgtgtccaaaggagaatctcactatgctgcagacatttctaaaaagtcaaagaagtagaattaatgagatagaatagaaatgaatcataactggttccctcctccctcaaatcagaaagaagtaactcactggtttgatttttttttcctaaaaggcaaaaggaactgcaaatattaacaccaacctggattttctatttcaacagaacttaaaggcacgtctgtgtcaggtgaggggagaggttttacatcagatgggcttttctatgaagaaataccataaaatattaataacacaattttctagtcttaagacagtaaaaagtaaaatgcttcagcttaaaaatatttttttctaaaattttttttcttttggttgaaatcccctttgcagagattttgttattgttgttgttactagttactggtataagcattgatttaaacttgtatttgtgttcctctatagtatttggtatttcagtaggagaaatatcacctcaaacactgatacttacatatttccctgctgtaataaatagtgaaagtgaaaataaaaataaaaataaagtgtgtgatctctgcat

SEQ ID NO: 685 - DNA, 14757 bp, Homo sapiens
tggggaaaggaaacttgtaaatatttttgaaatcaaaattataaggaattataataaaaattattaatgaacattaattaatcactaacagtgcaccaagcaccattctaaatgattggtaagtattaactcaatcctcactattgctctttcagaaggtggtagtgttatcgtcagtacattttacaaataagaaaagtctcagagagattaattaacttgtctaagacctcacaactagtaagtggcaaaacttggattcacacccatgttctctggccataaaaactatgtttttaaccactatgatattctgcaacaattttctcttccaacctctccccgctgttcatcttatgctctagaagctaacactcacactggcagtcttggtgttttccaggtagctcattcaatcttggggggaaaccttattgtacaaatcatctttttggccctttctacttcatcagtcagaattctttcatttgctttcagctttccaaatatttattgaatttactcatctcttgttattttcccttctgttattttcattttgtttttataatttagacggagtcttagaaaagagagaatataaactcaaatgatcatctgccatcttgatctaaaagggggatactccagacgtagaggagtatgatttacactagagtccatcaggtgtgacttgtgaccagacttaagcctgctttcccaaccttgtctccgacttttgagccccatatgttttaatgtatgtttctagtatatgcttcacatttccctgagtctgagtgcctccctctaatctctaacgctttaagtcctcctgaaagccatagctgaatatgatctctcttcctcagctcaactgctagaggactggtagtacctaaccagtggtgcgtatcatgttttctcttttattataataatttctgttttttttttttgagacagggtcccactgggtggtccaggctggagttcagtggtgtaatctcaccttactgcaacctctacttccccagctcaggtgatctttcccacctcagcctcccacatagctgggactacgggcatgcaccacaacaccttgctaatttttgtatttgtagtagagatggggttttgccgtgttgcccagcctggtctcgaactccttggctcaatcgatcctcctgcttcggcctcccaagaagcttcttatgagtattagcagatccttttgccgtggaaaaagaacattcagtttgaaatcaggtgctgtaacaaaatcgtgacctatatggcattaggttagtatatgggtgtcaggagataaagaattagataataaatgctagaaagcagcctatttatgctatgctgaggtaagctatttagtaagttttgtctacaataactttgaaaaaatactacgtatcttctgcatctgtagtttaggagagcttagaaagagctcacattttagtgtttgttgactgttactgcttttagcaatattgtaagaaaaaatgagttcaggaaggtattggctgattttccagaagaaattaaagctatcaaagtgttagaaaagccaaatacatctagtcctaaaactgtaggagataagactgaaaaagacttagaggcaaaatacatatcaatgcttgtcattaactgaaggaactcagccctatggctaagatcacaacgagaatatagttttcatcttcgcccattatttcactagcatcaaagaagctgccattaagttaaaggcaagtgctcaaaaaataaagagatttaaaactatgtctctgaaataactttgggtgtagtcaggcaaatggagctcagtgaaattgattagaaatcagcaaattgattagaaatcacaggtttctaagggaatcgtattgccaaagtaatcatgagactgacttgaaaagcctttgcctatttcctctctaaaacaaacctagcatcgtaagacaatgtgttgcaaaatctgaacagcttgcagtgagggcacactgcctaacactcacttaaatgtggccatagaattaaatgaccaaggaagtaactttcaaagtgcaaagccaagagccatggtgaacaatgacatttcttctacttcctgggaaggagtcttcacaatgtttgcccagtggattctatcattgccacggacctatgactgatgtgtgtttcacattaatctctcttttgaatggtaatttttattgcccatatcttagcccagctctaccaatgtgttttgggtatggtagtgggcagattactttacttttcttagtttattggttttctggccatgggaaactgcatttcaatctagtgagaaaacagtacatgccccaaaattcttggctttgagctacatgctatcagcttagatccataaatgatgatagaaagaataatcactttccccacaggcctagagtaatattcctgtaccattacctgagaaagaaataaacttcttgtgtgtaaacaaaattatgctttgggacttaaattgccctagttaatactgtatacaatcaattaggtgggataaagtaacaataatctcaggctgtgaaaatactcaaagtcaagtgggtagcagcaaataggctgggtaggtgtggaatcgggagcacatcaaggcttgaggatacagcaaagtatctgcttacaagaatagggctagccaagtgggcagaaaccagacagaagagttaggtttcaagtccagtttttaatcctggtggaggaattgtggggaaagtcattcctagaaatacaaaaaccaacattggtcactttgctttaagaaacttcaaatcatcaagaaaactatttttacttccctgtctgcagaatccttgagaaaaaaactctaggtctgttgtagttttgatttcaaaaggagtaaactggtctatgacataatcacttcggtggactctattctagacacagtgaaggagtgagatgtgaaggtgctctgtcattgcctcagtcaagactttcatggtacattggaagaaagagaagcgtgaacaaattgcatgatacttgaggtcatgctgtgtacctgtattgaacaagaataagggaagaaagctgggaacctggatctcccatatattggaagttttgtaaaaaccttgaggtgagtaaataaaaacaaattcttaaaggtttttcaaaaaacaattgattacatggttatcatgttttagaggattctgtttagctttagaagtgaagagctatatgggtcagagaatgtggcaacttataagttctatatcttttgctcagatggtcccagtgagagatgagggcttcatttgcttttcttttaggttttctttataagttgtcttagtccattctcacgctgccataaagaactgcctgagactgggtagtttataaaggaaataggtgtaattgacttactgttccccatggctggggaggcttcagaaaacttgcagtcaaggcagaagtcacctcttcacagggtggcaggagagagaatgagtgccaagcgaaggggtaagccacttataaaagcatcagatcttgtgagaactcactcactattgtgagaacagcatgagcagcatgagggtaaccaccttcatgattaaattacctcccacagggtcccttccactacatatggggattatgggaactgcaattcaagatgagatttgagtgaggacacagccaaaccacatggtaagtcctggtgggaaccgtggtcattgctatataggatgactattacagttctagaaataaactctttcctagagcagacttattttgagggagaaacaacagaggcacatttttctgccttctgttgctgggagtgcactctcttgttgcttcctcaggtgctaaaatggagaagtagcccgatttttcaaactaggatttgaattatgaattaaaacgtattaatctgatgaaggattatatacacacttgctcttaatattatgtcaaactgatatatttgacatatatatgttttttaaatttaattattaatttatttatttaccttaagttccaggatacatgtgcagaatgtgcaggtttgttacataggtatacatgtgccatggcggtttgctgcccatatcaacccgtcatctaggttttaagccccgtttatatttttattgaggtaaaatatacatatataatttgccatctttaccattttgcatatacacttcagtggtaataaacacaattgtgttctttattttgccttcatcatcccctccctgctctccttcccgtcctctggtgattaccaatctacccaatctactttctgtcttcatgaagtccacatgtttagctcctacatatgagtgagaacacgtgatatttgtctttctaatatgtgttaatattaaaaaaagttttagaaacacttcacatttaaaaagtggaatcacattccttccaaggtatacgaactaagttgtcttattgttgagttaggaaacagatatttctggctttccttccctttgaaacatttctccttcagctttcaaggcttatttctgcagagtcacagcacagtttaaacacaccccaaaaagcatgtttcatgagatatgaacatggggcaataccaagatgtctctggtcttcagttttgaagtagagctctagcttagaaatattcaacagcaaccaggaatgttagtactgcattgtaagtccgtggcactatttcttgaacaaatacaagaagaaagaaactactgagtgttgaagtttttctttttgagctttaaaatttatgcactacatatttttttagttcagaataatcatactatgttttctattttttcattaaaaattcatttctacacatattttcacttgtagacaaagtgtacacgcactttttaattggctacataatagtctattttgttaatatgctaatatgtaaattataactgacacatagacattactaagttagtgaacatttgggttattttctttttgctatttgttgatgcaattaatatgtaaagtcaattacaaaataataatttacacttttttgtaattttactggagcacattcttcaaaatggaaatactgggccaaaaatatatagacaaatttgtgaattttggaatatattgctctattgtttctgagtcaatttacagttactaataatgtataagtattttttcccattatgccttatctaagtcatcaacaaatgcttttgctacattaatacttctatctgtataatggttgtattaagtaaacaagactcatagaattcaattagaaataatttgagtcatggctcctgtgtccttttaaatgtcttctgtagaactggtccttgcattgttcctctgcccaaacatcccattactcttctggtcaccattaggtaatacaaatggctctccagtttgtaattaaaatgtctataccaatgcaataatcaacatttccattctgatttaaaattaatgtttgtatttcttctcttccctggattcaggaaaggaatgatctagtcaacttctccccaaccccaaactggagcatttattccttttcttccatcttgccactcaaagtttctaaaccctccagcactggaacacaggaaggaaaaaactaggtaaaggagtaggaaagtccgactagaccaatatttcacagtggtcccacattttctcttggcagagttttacatttgaaccttcctcttataggtattcttgagagttcttcagaattttcccatcacttgggacttttcatctgatattctcttggcttgtataaatccatgtctgtttcagttgtttgcctgcatccttcttcagtccctcatgggtaaacaaagtattagatgtctggcaacacttctgttttctttctcttaaaagttattggcctctctaggaagtcatttccaacatgacaaaagataactcacaggaacatttttttttttgcagttggtgtgtatagagcccacaggaaactcattttttcactgcctcttaaaactgtaggaatgcttgtcatccctagctttccagtatctccttaatatactttcagggcaggactggggccatttttttgccctttagatatctcaagtaagagtcataattctctgacattccaaggacacattcaagttctcccaagaccctctagagctcttgacaaagtgaagagagaacctcctcacctctcctccttaggagagaccttgaagacacacaaacagctctctacactcccttttgttcagtcaccaactccttacacttttattcttttactgttggtgagagttttagaattgtacaatctttagacatttcctttggaaattctgtattaagtcttatatgtcaacctggaatgcagtctttattggatataaggtgtcagcccgatcatctattttggttttctattactttagctaagactctttctattataaatgacaaaaagcctaatttaaaaaaaccagcttaagcaaagaggggatttattgactcccataactgagaagaggttttgtctgcttaggcacatctggatgcacagctcttcgggacctagctcactttctcattcttcctccattcctctccctctctcctccagctgtccttcatgtgatgactttatgttcagacaggttatgctgatgtatccagcctagtctgctttccatgttaaaaatgatcccaggtggtctatatcactttccagtgttcaaatttggaaccatacgcatactaaatttgataatcagtcagatgatgagcactctcaccttccctttctcatgatttcctggcctggctgtgatacctatacacaagtattttacaccattcttactccaggctgctcagccagttgtcaattttaagatccctcattctatggtcacacttttgacattttaagtgtaggtttaagaacaaatattatcatacctcttaataattaatttcttttcatgggtaaataaggtattaggaaataataagtgtattttaaaaaatgaataatcacaactcagggtacaaaactatgactgtattttttccataattggattttttttttattttctttttctttttttttttttttgagtcggagtcttgctctggcacacaggctggagtgcagtggcacgatcttggctcactgcaacctccgccttccaggttcaaacgattctcctgcctcagcctcctgagcagctaggattacaggtgtgcaccaccatggccagctaatttttgtatttttagtagagatgggatttcaccatgttggccaggctggtctggaacttaggtgatctacccacctcagcttcccagggtgctgggattacaggtgtgagccactgcgctcagctggatttattttctattttgagaacccacctgttgtgtcttttgcagacaagtaatatagtatcttgcaggtaaacttataaaacataactgtgcttatccttttatttttctttctcttgtattaattatggcttaacactaagctctacagctatatacaaattcaatataagcacttttacattctttaaagataaattagggctagttctgaaaagctgcttattttcccatacaaaagcagattttgtatagaatcatgtttgagtcatcttttgctgtaatatacctctttccatcaaaaagcatttgtgcgcttcctccttatggtttaaccttggtttagtttctatgcaaaatttaaaaaaatccaggggctttagtctgagggaaacagttgtggagaatatcactctacacattatatcaacatgtaaataaactagacacttttcaggtttaagaagatacgggagagaattgcaaaagttgcacatgactgccatgaggattatctctcactacatgagagtaaatttttttccttttggactgatattaatagtttcttcttgtttttcatttttctgtataaatatataactcttgtgacatttctgccaggcagttattctaatcttcatatttcagataaagaaaccaaagttatgtgaataaatagtgaggattcaaatcctggctccaaatctgattctctgtccacatcacgccagaccaaacctttaagaggtcactgtgtatcatgccattttaaatattaataaaggcttcatgaaataagaagcaaattttgttaagcctctcaggagttacaaaaatgaattaaagttcttgcttttaatgaatcatagttaagaagggtatggaattcagatcgtagtaatgctacaaaatatgcataagtgctgtgaggattcagaggagatgtttacatctagatgctgaaagtgggttagcagttggcaatgcacatgccccctaaatacagctgagggcataaatgcattagaactggttgacacagtgagaggcctatgcatcactttgggtcaaagtatttatttatttttatttaaataacatttggcttttaggaatttcttctaagaaatttgctacatttgataggatatatgtttagaataaaccagaaggctattcttcaatcactatatatcaatatcaccaaaatacgcctttgtccatgctgttctttggctctccgttcagagttgtttttggagttaaatttctattgcaagaaaaggtcattctttcttcacaatgcctctcagccttctccattcattttttccctcatttagatcttttgctcataacgacacaagcaaacaaccagggctgaagagtacaattccataatcagcatcaccaaaccttcccatcccatccccaattttaagaaatccaacatgagccatccatggggtcatggtatcttcacaggaaagatttctttattacaatattttgctgatttaattataaaaatacaagggaaatggtcatttcttcccccacgaataccaaatttaactatgaaaatttcattgctgattcgaatgtcacctctggaacctttgttgaaatttaattgccattgtaacagtgttgggaggggcctttaaggtcacgattaggtcatgaggactccattctcataaatgtaataacgccttatagagggaatgggcttctgatgaaaggatgtgtttggcttcatttcctctctcttcatcttacgcttttgcttgccttgctgctttgttatcatgcagtaagaaggttctcatcagttacaaggcagatgtcagtgccatgcccttcgccttcccagcctccagaactaggaagaaaataaatttcttttctttttaaattacccagtctgtcgtattctgttatagtagcagaaaattggctaagacattcatatatagaagtacagagaaattgcttggaaaagttcaaggaggtcaaagcagtttgtactttaattattcactaaattctgtagctctggttaagaaggcacattcactctgatctcttcctgtctttgacttgtaaattactttagcaaaaaggttaatctcaccctctcttgtttcaacatgttgcttttattaaaaatgtaaatttaaaattaccttggcatttgggtcattaattggattaattaacctaataatgctcttaaaattacttttaaaaaacatgtatcaacagaaatgttcccttcttagtctcattctctattttaagtagtcaatatagtacaaaaacactctccgaacatacaagtaggttaaaatttagattttttaatttattaaaaggtaaatttctgttaccatgcctgaaaatatgcaaaatagaaaacatttacttggttatcacacaataataaaaagtcatatagatttttattagttcggaaataaagtatcacaggaaggtcttttttgttttttgtttttgctttttaagttttactacaaatgagtgacagctgtatagtcacagtccttagtttctatatctagaaatttcctttaaatggtttaaagcaatttccaaagttttattaataagagaaactgggactggacagattaaagaatttaattgagaaccttatagtaacctattaaaatattcacctgcatgtccggtttgcacatcttgttgaatttagagttgagtttctgttataaagaaaggtcgtaagttcttttccttctccggatactctacttacacaaataactctttcagtggaatgcaagcttcagtgagtgctccgacacagttctactgttagacaaattattttaaatatggcacttatatatatgtaatatttcatattaatgggaaaaccttttgtgttgatttatgcattaaatgataaatgtgtgtgtttgtgtgtgtgtgtgtgtgtgtgtatggcatttctgagcataagctttattagtgtgaacaaaatatagtaatcattcatgtaatattatatcttgcctgttcagcaatgaaggaaatgaatgataggactttagtgtccccttaatttatttaaaacaatgaaaccagactcaaaagtttacaataggaagaaaatctaaacttcatctaggtatttcaagcctttcatttgacagaatcatcattataatacaatagaataggttaagttaatattaaacaaacgtagatgaattcaactaaagttttggatcagaattctcaaacaattctaaaaattatgctaacacacaaaagcaagcattcaaggaaacatttgttctttatcttgaaatattaatgagcagagatttttttccccatcattgagtcactggaactcattataatgaaaattgcattctgaaattgtacaacttaggcaggtatataatttattggagtgtccagtccacatgttaatttttcacttgactgaagtcttatgtcttctttgtgttctttccacatttggtttggtgaacagattctcattgatcacttgtctctagaaggattatagtaaaaaaaatacaagaccgaaatatgagacatagttatgtttaaacacaacaggaaattaatgcacagtatacattttaggattctacattcttgcagagttgttcttgaatgtaattagtaggaaacgaaaggactctccttacatattagctctattgtcaagttttgtgtaaagaaaaatacagaatttcttagaatatctattctaaaagccttaggtaaagaataaatataattgctctgctcctagtttctacagagataagaaacaaacagccaaacttgtatagaggcaaaatataatgtgaagccagtaaatgataagttgaatcacatatgcatgttaaaatttaaggcatgtgtctaagtctgtcatgtctttttaaataatgactttttttttcccccaaggagaagtctgcacaaaagcttatggccaagttcctctctggttctagggtgtaaaagaagggcactgggctagttttctccagtaaacccgatgctccacttttcctggttggaaggttgaatttatgttgctcctagaaactgcatgaaagggagaggggagcccttgctcttccagaagcagagcttttccagccttcttctatttgggcaccacaggaactgtgcatctcaaacattctcctgtgggaaataggctagtgggtcacatatgcatgccacagtggccagctgactcagattcgcttattctcatttttcaccaatcacagatcatgtgcacttttagaaggttaaaacaatttatactctaattactcctttacatcattagttcttgttgagatggtactgtcattttaacctcttatgcctttggcttataaactaatttagagccatattctataaaagtagaaataaagcattttaaataatctttaataatgtgttttcctatgttttctgtgaggtgcagtcagaattcataacttgtctcactaacatactaagacatttaataacttcacttgcacaaatgtggggaaataaagtgagcctaaagtttggttcttctgactttccactgccattacacatatttgagatgtgaacagagaaccaaagcagcaatcctgctaatgtggaaatgcatacaattctttaagtaaacatattctgtcttccatgcttttactcactcaggctgcccttctgctaaaactaccctgccctagctaatatctatctgtcttttaaggctaatcccaggtgatttcatcttcagaagcctttgatacctgtctcagtctctgggacaagtggagctattgcctccactactgtagaacttgttcactgcaatgacattctgttttttccattagtctctcagcttctaaaggacgaagactcatattggtatatctaatgtgagtgtggtgcctaccccactgtatgcatttagcaaatgtttgttgcacttaactgaattaaactacaaggacatcttgatgcactgtggcgtattaaattgtgccaaacatttgagatgcttaaaattgtatgaaaaaaatggcaggggaaactctaaacaataaatttgtctctagaataaataagtagctaaaaatgtatataaatttcagttcgaaaaataggctttaggttgtaattgctccacttgaaaaactacatcaagacttttttgtggaacaaggcagaatgcagataaaatgaatattttacagatacttgttccagctgccagtccaataacaagataaccttagtaaatgaagtgaatctggcatatgactcaaaaacttccgttgtttcaagtatctgcagattggattttattaatccttttagctgagaatcatatctatgccattcatttccacatagcaggaatgtcttaggattataaacttatgtaacaattactcttaagctttaagaattcacatgataatgtgatgtggcaaatcctgcatataacctgtgtagctgtgatggatcttgaaaactctgtgttctgtgactctaaagtctagaaaacctagactggcccagggttaaaatcgaaatccagaagcatacaggacctctgatctgtcatgatttctgaaaattatgggagtaaaatcagttgattttgtagaaggcagaatgaaatctcttttgcttgagaaataaagctcattccagagacttgttcttagtaactatctcccaaaatagatgtcatttgggtttatgcttcaggcaaagtttaatagaaactatatgctttcttagtgagttcataccaggggccacggtgaataaaacaaatgcaattggctagggatttagacagacagtacaggtagcagccactactcagctcttaggaattggtctcatgctggtatgaaggctctcagcattttgggagtttacatttttccccagaggaatagcaatacttgatttttaaaatgtaacaatttccgacttttaaaggttgacaataaatattcttttcaaaaagcactatgtggtttaatactgttctggataaacaaaatatatccatggcctttcacatgttttgtatctgcttagcacctgggagtggagatgaaagcatgtgccagatggcttgccagtgtgcacaggaggtcatttgggaatgacactatattgataacatgctatattgatatagcattgatgtcagtgctatattgataacagctaacaggcatgaggacttatgatggccacaaatggttttaaatgctttaccggttgtagctcatttaattctcattaaactttgtgaggttgatactatcattatccccatattaaaagaggtttagtagcttgctcagggttacacagctaataggtgttggagcatggattcaaatccaagtctgatttcagatctggggctaattcactatgctacaccatactgaccatagagtctcctatacacataactttgcagtttgggaaatacgaagtacacttggttttctcttttgcttttactatttgattgagtttttttttttttgttaaaaaaacaaaacaaaacaaaacactttgtgtccaaaggagaatctcactatgctgcagacatttctaaaaagtcaaagaagtagaattaatgagatagaatagaaatgaatcataactggttccctcctccctcaaatcagaaagaagtaactcactggtttgatttttttttcctaaaaggcaaaaggaactgcaaatattaacaccaacctggattttctatttcaacagaacttaaaggcacgtctgtgtcaggtgaggggagaggttttacatcagatgggcttttctatgaagaaataccataaaatattaataacacaattttctagtcttaagacagtaaaaagtaaaatgcttcagcttaaaaatatttttttctaaaattttttttcttttggttgaaatcccctttgcagagattttgttattgttgttgttactagttactggtataagcattgatttaaacttgtatttgtgttcctctatagtatttggtatttcagtaggagaaatatcacctcaaacactgatacttacatatttccctgctgtaataaatagtgaaagtgaaaataaaaataaaaataaagtgtgtgatctctgcat

SEQ ID NO: 686 - DNA, 26245 bp, Homo sapiens
tggaaacttcagcccaaaatagcaaaattaagtgtgattgaaaccaggttgtattgtctatcatatgtacagataagcaaaaattataaacaacataactggattcaataaaaacttgggtaattcatttatgggaaaccaatagcctgtagccatgtagctattagaatgattagatttgtactgacacagaaagatgtatcaaattataatatgaaatcagcaggatctaaaattctaaatatcccaattctactttatttttaatataaaaatatgtatacaatcatacagaaataaatagaaagaaaacacattaaaatgttagcagcactggtttatctccaggtggtagaatttgatgtagccaatccaaattttctctataactggtattaacactctttaaaaatgaaaacagatttcaatattaaaatattcagtatacttctaaagccagattttttttttttttgaggcggagtttcactcctgatgcctaggctggagtgcaatggcaccgtctcagctcactgaaacctccacctcgtggattcaagtgattttcttgcttcatcctcccaagtaactgggattacaggtgcccaccaccatacccagctaagtttttgtattttcagtagagatggagtttcatcatgttggccaggctggtctcgaactcctgagctcaggtgattcacccacctcagcctcccaaagtggtgggattacaggcatgagtcaccgtgcctggccagatattctttacattttgaattagtggccaggcatagtagcatttccctgtagtcccagctacttaggagtgaggtgaaggtgggaggatcacttgagcccaggagttctaggctgcagggagccgtgatttgtgccactgcactctagcctaggtgacagagcaaaaccctgtctctaaaataaattaaaataaaaattctgaattagtgactgttttctgtaaaattcggagctacaacaccaggcgaaccagaagccccacgtataaggttttaattatttaacaatggccattttcttttcttttctttttttttttttttttgagacagagtctcactctgtcgcccaggctggagtgcagtggtgggatctcggctcactgcaagctccgcctcctgggttcaagtgattctcctgcctcagcctcctgagtagctgtgattacaggcgtgtgccatcatgcccagctaatttttgtatttttagtaaagacggggtttcaccatattggttaggctgatcttgaactcctgaccttgtgatctgcccatcttgtcctcccaaagtgctgggattataggcatgagccatcacgcccagccaacactggccattttctaatagagattctgaaaaaggaaatatgtaagactctgtatatagactctgtacacagactctgtatataagtatcagtctctgttgggagtgccattctaaggaatgattaccaattctgaaattcagaaaaggatctatgtaaacataacaaccgaggccaggcacggtgcctcatgcctgtaatcccgcactttgggaggccaagcagggtggatcacttgaggtcaggagtttgagaccagcctggccaacatggtgaaaccccatctgtactaaaaatacaaaaattagccaggtgtggtggtagatgcctataattccagttacttaggaggctgaggcaggagaattgcttgagcctgggaggcagaggttgcaacgagctgagatcgtgccactgcactccagccttgtgacagggtaagaatctgcctcaaaaaaaaaaaaaaaaaaagaaaaagaaaagaaagaaagaaagaaaaaccaattgaaaagagaaaaaaactattcattaaaggaggttttttttttttttttttttaacaatctcacagtgtcacagtggggaggatttgtccaaacataacgcaaacttcaaaaactacagaagatttgactacttggcaaagaccacaagaaaaaccatcaaaacaagcagctgagagaaatctgcaactgacatcatagacaaaggattaacttccttaatctgtaaatactgtctgtaaaccaagaaaactagacaatgcaagtatacacaagttatcaatacaagctgggtgcagtggctcatgccttgtagtccctgcactttgagaggcagagatgggaggatcacttgagccaatgagtttgagaccagcttggggtgcatagtgagataccatctctacaaaaaaaaaaaaaaaaggaaaaaaaagacatataggctgggcacggtggctcactcctgtaattccagcacattgggaggccgaagtggacagatcacctgaggtccagggttcaagaccagcctggctaacatggcaaaccctcatctctactaaaaatacaaaaattggccaggtgtgttggcgggtgcctgtagtcccagctacccgggaggctgaggcagaagaatcacttgaactcaggaggtggaagttgcagtgagccgagatggtgccactgcactccagccttggagacagagtgagactccgtctcaaaaaaaaaaaaaagatatataaatacagaatagtagttatttcagggaggaagggagacaaaagcaatcagggagaagtccacagaaagtttctaaggtactagttaatatcctattctttgttgtataaactaggtgacgggtacagaggtgttttattattcttaagtctctttgtgtgaacatgtgtatgcgtgtatatacacatacatttacacacactaatatacatgcatatattctgtatttagagtaaaaaaaaaatcacatgcattaaagttttgattacaccacgggctggagtaaaggggaagagagacttgcaagtaaaaatgtatgtgagcatttctctggagaactatgacatctataaaaattccaatgcacataatttttgatccagtatttctacctccaggaaattcactccacatatataactgcacatgtattatatgaaattacattatacaaatctatttattgtaacatcatgtgttttagtgaaaatttgaaaacaaattattgacagggagcctaatatataaaacacactactgtgcttttgaatacacatgcagctgtagccacacacacacaaacacacacacacacacacacacacacacacacacacacaaagtctttagatagaatttcatgagatcggccggaggcggtggctcacgcctgtaatccccccgctttgggaggctgaggcaggcagatctcctgaggctgggatttcaagaccagcctggctaacaaggcgaaaccctgactctactaaaaatacaaaattagccgggcgtggtggcgcatgcctgtaattccagctacccaggaggctgaggcaggaaaattgcttgaacccaccagacggaggttgtgtgagccgagatcgcgccactgcactccaacctgggtgaaaatgagactttttctcaaaaaaaaaaataatttcataatatattatttggggaaaaatatatagaaaagtatgacataattggtttattaaaaagaaatatatacattcagactctctgtagagggatatctgatagagaaatagatatggaaagtgtattatctattcaagaaataagttttaaaaacaagtttccacatagacttgtaatttaatgatcataccaaattaactgcatcttgtgattatacgtagaatgatttcagtcacacaaattaaaaccttaacagaggaaagggaattgcaaaaaatattctctatcaaattaattatacttgtattggggtaatgaaactcagaggggcagttcatatttctccatttttataatgaaagttcacagatttgtaatacacttagtgtgtttcataagctataatagagagttgtcctgacaatatttgaagaaaaatgacattagttccttcctcctgtgtaggaaaaacattcagttgctcttccaggtcattcaacaaagaccttttctttcttttttctttttttttgagaccgaattttgctcttgttgcccaggctggagtgcaatggcgcgatctctgctcactgcaacctccgcctccctagtgcaagcgattctcctgcctcagcctcctcagtagctgggattacaggcatgtgacaccatgcccggctaattttgtatttttagtagagtcggggttttgctatgttagccaggctagtcttgaactcaacctcaggtgatctgcccacctcggtctcccaaagtgctgagattataggtgtgagctaccatgcctggccatgaccttttctttttttaacctcagctttttattttgaaaaaagccaaatctcagtaaagttgaaaaagaattctaatgaccatctctacatatgtccatgttttgcaaaattgggcttatcactttctcgctgttctcagacacacatacacattcaggctcttgttttgatttgacaaaaatcagataactctgtgtagtcctcagtcctcacagtattctcagatggcagcgttacagagcagccagggttcagttgtgaaccaaaagaactgttctaactcctcccccaccctcaggaggaaagcaattcactggagacctgtatatccattctagtctaccagagagggcctgggacagaattgtatggttacagtaagctgaggaggtatcttttcgttgattcaccaatatgttctgaattgggactctggtatctaggaacacatattccaatggtagaagatcattcttttatatgatgtgaccgagtacaggagatgtatcttatggctaggaattttctgtgtaaacccatgcatcagagaaaaagatgaaatcagatatatacctttcactgagggattatcaatccatctctaggcctcgaattccttactattatttagaacatcgtcaacctgctgttgaaaatgaaataaacatcttctgcaaagtttatttattttttattttattattattttttttttgagacagagtctcgctctgtcaccaggctggagtgcaatggcgcgatctcggctcactgcagcctccgcctcccgggttcaagcaactctcctgcctcagcctcccgagtagctgggattacctgctcaatgctgttgtagcagagggggaacatccccagggagctgcagactggtgggaagagcaggcaggcacactcgacacagaagcccagacaaacccttggtatcatgagtggctcaaggtcagagataaccaggcccgtacatgctgtctttccacgtcagacttgtattgatgctatttaaatcataaaagccaccagctccatggagttcccagggaggcagttctccttagtacttcctggtcactcggtggtcagagctgcgggcacacaggctcaagccactccacatgtcagtcgatattgcaaaccatacatcatagtatacctaattaatatatcaatgttggccgggcgcagtgtctcacgcctgtaatcccagcactttgggaggccgaaacgggcggatcacgaggtcaggagatcgaggccatcctggctaacaccgtgaaaccccgtctctactaaaaatacaaaaaattagcagggcgtggtggtgggcacctgtagtctcggctactcgggagactgaggcaagagaatggcgtgaacccgggaggcgaagcttgcagtgagccaagatcgtgccactgcactccagcctgggtgacagagtgagactccgtctcaaaaaaacaaaacaaaacaaaattccacaacaaacaaagtagcatttaacaccaagagaaaggggataggaaagagcgttaatgaaccagtcccaaagaatctcctggtctggcccaggtggcccatcagtcttgcaaggaagagtctttgatgtgggcagagcctttggtggtagattctgggtaccaattaccagtgacagcaagatggggtctgttaagatggctgtttcgagctggtgaagtcctgctgtttgatagccccagagtcctctggtgaggactgattgtggaggagtgtgcctggtgatgcccttatctggctggatgcactctttgttgatcaggtgaaacatttggtccctgttggcaaagtgctttgtgaaatagaagatggagtcttttgttaagatggaattacttatgtcaatggtgttgtatacacttgacaaggccagatgacattcccaatttgtttttataaatagtagagaaacttcgctggaggaggagggtcacacatagcaagagcagagggcttggtgcatcttccattccagatgctactgagaatgtgcaaatcagtgtcacgacggatcccaaaggtttcatttcaaactgagccatggacattttatagtgcctaacttactattcaaaaatactcacacacacagttttgtttgtaacatttccactcatagaaattccacaggctttggtataggaagtgtcagcggaacacacctttaccctggggtaaaaagcatagtcttccctcacagttaatgctctcaatcttctgattctgggtgtctggtagatcttgtgtccccagaggataaatcaatgtattttaaaagtattaataatcagtttacagccatgcattgttttataatggggacatatgctgagaaatgcatcattaggcaattgtgcattgtgtgaacatcatagagtgtacttacacaaacagatggtgtagcctcctaacacacctagattatttggtacagcctattgctcctaggtacaaacctgtccagcatatgactgtactgaaaatgtaggctgaaaattttattttacatatgtaggcagctgtaacacaatgtaaatatttgtgtttctaaacctggaagaagcacagtaaaaatacagtattataatctcatgagaccaccgtcgtatatgtccgcagttgactggagccgtcattaggcagcatatgactgtagtccattaattttaagtattcaaaacaatttccatccattcacaattcaaacaattgctcacaattttgtacagctattaatccaggaaaccattagcctaggaagccaaatgtttagttagacacaagtttagggaaacatttgagtattgctggaggacaaaagcactcactaaataaccagtggctgattaccggcctctggaccatggccagttggaatagctccatgtcattctttctttctttctcttttttttaagttttgttattacaagaataattttctatattagactgttttcactttattaactttatcataagtatgccaacttctgcaaacttggagcaattgcaataatctattgatttattttcaccaaattttcactttatttgcccagaattcaagcttgtctgttaatttcccaggtcttcaatgacttgtctcttattggctagcatctccttattttccttgttcaattagtaaggttttccttattatattacttttttggggggcctttctctgttagtatatagattttctcctgagagctaaaaatcttcataacaccttagtcaatatacctttgaaaaaaccccttatattggctggttgcggtggctcacacctataatctcagcactttgggcggccgagatgggcagttcacctgaggtcaggagtttgagaccagcctggccaacaaggtgaaaccccgtctctactaaaaatacaaaaattagctggatgtggtggcaggcacctgtaatcccagctactcgggaggctgaggcaggagaactgcttgaacctgggaggcagaggttgcagtgagccaagatcacaccactgcactccagcctgggtgacaagagcgagcaaaactctgtctcaaaaaaaaaaaaaatcccttatattataattgtcattgaaataatctgacattcctagtaacctctgacactaaaattttcttcgcttttaatagaaacacaattcatcatttatccattatccattgttttgaatttaatttaattcaccaaaataatacatatattttagtaccaaagatcaaaaagtgctcgaaggtttataattaaaaaaaaaaaatcctctcttctcccccattccggctatctagatacagtcatgtccaactctcagttctttcttatagaatatgcatgatattccctcatctttcatttaagttaaggaatatcatgtatattctataagaaacagaatgaggcattctatttctatttccttagaaatagaaattggaaatagaaatctaaattggaaagattggccagttgcagtgactcacacctgtaatcccagcactttgggaagccaaggtggaggactgcttgagtccagaagtttgagaccagcctgggcaacagagcaagacaccatctctacaaaaaggtaaacaattagctgggcgtggcggtgcaagcctgtagtccacgctacttgggaagctgtggtagaagaatcccttgagtccaggaattcaaggctgcagaatgggcagaatgactgtgccactgcactccagcctgggtaacagggtgagaccctgtcgaaagaaaagaaaaaaaaaaagaaagaaaagagaaagaaagaaggattatcttttaccttttacttgctacagataacttccctgccacctcattccaatatagtcaaagcaacattttattaagccatcaacacctttgttttttatggagttaacagttctctctatatatatttagtttttttttcctagtgtaccaaacacagattcatcccttatactgtcctatggagctataaagcttttcttgacatagccaaacggctaggaaataatcaattctatttattttttccttcaaggtacccttctgtgaatcttccaccttttgttctaattagggccaactgatgctgtcgtcctgggaattttcccattcaccatcactttgctaattccttcacctctttgctttcctgtactcaggagacatccttggcaaaacttaatggttgctgggtcatgatgaaatattataggcatactagagaagctgcttgattaagtagccatcagttcgacaaaacaaaaaacaaaaacaaacaaaagctaatttgtagagttttttagataaaattgtcctgtgaaacttcaaaatcaagcttcctcatctgttcattaatgctgagatctttgttttgttccttcaggtaaggcaaatacccgacatacagggattgtttaataaacactttctgggtttcttgttcattcatttaacgcctttgccatcatggggtttccattccagacaggaagttaaatacataatgttaaatcaggtcatgattaatgctacaaagaaaataatgtagggtaagaggtaagagaatgagtggggattggagagaatgttcagggagggcgctctttgtggaggacagatcaagaaaggcctgtgtggtggcagccagctggagcctagcactgcggtccagatgaaagatcacagcctcaactagtgtggtcaaagggaggatggcgagtgtttgctgagggacatatatggatggtagagctgacagtctttgctgatagattgaacacagaatggcagcaaaataaaggatggctccaaagtctgtgctgtcagaatgagcccctgaagcttttagaatgcacggggtgcctgcgagggtggcacatttgggaatctagttggctctgactgaagctatggagaaacgtggcaaagaagtgaggaagaaaggatgctgaggcgggcttaggaggccctttattaaagcctggctgtgtttataatcgcaggcaagaagggaagctaatgtagtaattcagaaggatgaagagaactaaattgaggaaataggttttcatttttatcaagcaattcatcattgactacgactccacattaattcagctctacccataaagccaattaaattaccccaagaaatcaataaaaacacaggcagggtggggaagacattcttgatgaacattcacacgtcttttttataagtatttgggaagagatttcgggctaaaggggtgaagcatgttccctacatcactgtagacctaggaaacgaattctatttctccttttccctccatacaagcaatctaactccacaatgaagatagggacagcacattctcaggggaaattgacatggacagttcctggactatagctcactcctatctgaagctctgaatgttaacatccaatgtaggaacagcttttagcttcagaaattccacaggccaaagaacaatgataaccattaagaagattgcaacaggagcttttacctccaccctctttttcaaatacaaagttctcttgtatctctgagtatctggaatgaccacatagttctcctatctgaaataagacagacacacaaaacagggtaatctagctgaccagagagtgctgggataaacacaaagctcactaaaacggttagggaggggaaaagcttattcacatagttttaacttttttttttttttttgagacagtctcgttctgtcgcccagggtggagtgcagtggcgtgatcttggctcactgcaacctccacctcttgggttcaagcgattctcctgcctcagcctccagagtagctgggactacaggcgcccgccaccacgcccggataattttttgtatttttagtagagacggggtttcaccatgttagccaggatggtctcaatctcctgacctcgtgatctgcctgtctcggcctcccaaagtgttgggattacagacgtgagccactgcgcccggccaatgtttgtatttttagtagagacggggtttcaccatattggtcaggctggtcttgaactccggacctcgtgatccacctgcctcggcctcccaaaatgctgggattacaggcatgagccactgcacccagcctggttttaacctgttttttaattaaaaattttattttacataaatacactttttgaaaataattttaagtttccatcaacggcttcctttgagtaatgtgaacctcacttccacatctttgccaggcctcgacttccccaactctcccctccagtgagcctgttatctgtctgcaaatacttttaacgagatacaatttgtgtggttggaaagaataaacagcccaggtttcaagagtctgaatatcactctctggagattttgaatgtattggctctatttctgactcagttaaaaaaaaaaagtactgccacttagggtagatgaggtcatagaaagcattctgaaccttccctggcaggtagcaaatgtacgacaaactgaaattgctattttgaaaggagaagcaatatttacatttacatcctttctatttatcattctaccacatccatctatcattacagagaattccttcttctcatgtgaggttaaatttccaatctcatacttgattttttccaggtcaaaagtctcattctcttatatatgttccaatttgtcgaggcataactgaaatgcaaatttacccatgttttgccgttacccacctacgtgttttttaacttccatgtaccattgataatatttatcacattccagtcagaaaatccgaaaaatcaaagcttcaaattccttccttattccctgtgaattcttatctcctctctatcctgtaattccttttcctgctttgtgcaagatcaaaaaattaactgcagtgaggtcacttacctctctccttctttcagccctacacagactatttcaagctgactgccctgcctttccattgaagacagaaggagctggtctagattcctatgagctgtgagatttcctgagcctctcccgctaatccttaacccagaaatgtattcgtcatttggctataaaaaaactcacagcttgacatccctgcacatgtaagagcactttttccaagttataactacagaacaaaactagatattctactttattgatacatttgttgtccaaggtacatttaccatatacaaatacagagacatcttttcagtgtagtgaggtaatcccaggcgttccatagcactggaggccccactggccaaaggcttcctaggtctacttagctcaaatatccaactcttacactttcttttttttttttttttgagacagggttttgctctgtcacctaggctggagtgcagtgacttgctcttggctcactgcagcgtcgatctcccaggttcaagtgatcctcccaccgcagcctcctgagtatctgggactacaggtgtgtgccaccatgccaggctaatttctgtattttttgtagagacaagatctcgccttgttgcccaggctggtctggaactcctggactcaggtgatcctcctgccttggcctcccaaaatgctgagattacagatgtgagtcaccatgcctggccacttaccgcttttatttatttattttttttttgagatggagtcttgctctgtagcccaggctggagtacaatagcgtgatcttagctcactgcaacctctgccttccgggttcaagcgattctcctgcctcagcctcccgagtagctgggactacaggcgtgaaccatgatgcccagttaatttttgtattttttaaatagagacggggtttcaccatattggtcaggctggtcttaaattcctgaccttgtgatctgcctgccttgacctcccaaagtgctgggattacaggcatgagccactgcgcccagcccacttatcacttcttaaagctacttccaattatactttgcccaattaacaatcttcctaatacagctgtttcattataactaatccctagcaccatcaacacatttttacatttaaacagtaaaccgtacactacaccagagccactgaacaaaccgcctgttgttttctatttcttgcttctgccaactttgctgtttgtcttggttggatattgtaatcaactaaggagctttgaaaaaaaatgatgcctagttttcaaccccaaagattctgatataattcttgtggagatatggtttagatattaggatttataaaaacttctcaggtcagccgggtgcggtggctcacacctgtaatcccagcactttgggaggccgaggcgggcggatcacgaggtcaggagttcgagaccaacctggccaagatggtgaaaccctgtctctactaaaaatagaggaaattagccaggcttggtggcaggcgcctgtagtcccaactactcgggaggctgaggcaggagaatggcgtaaacccgggaggcggagcttgcagtgagccgagatcgtgccactgcacgccagcctggggacagagcgagactccatctcaaaaaaaaaaaagaaaagaaaaaaaagaaacacgtgggccgggcgtggtggctgacgcctgcaatccaagcattatgggaggctgaggtgggcggatcacgaggtcaggagtttgagaccagcctggccactatggtgaaaccgcgtctctactaaaaaatacaaaaaactagccaggcgtggtggcgggcgccagtagtcccagcaactcgggaggctgaggcaggagaatcgcttaaacccaggaggcggaggttgcagtgagccgagattgcgccattgcactccagcctggcgacagaacaagactctgtctcaaaaaaaaacttaggggtagagcaatgtctctcaacattttcgttacattagatacaaaactggttaaaaccccacaaggctataaaatgaaaacctttgagatgatctttttctaccagaccgtctacagattttttggacttttttccttaatcacttcctccctcatgaaattttactaccacatacatactgcatatgtttatggactgggctcttttggagggccctagccacagtaatatataagacttttttcacctctcatgaaccgatttttaccaattgaactcatgggttagaagtacaatcatgtgtgtgtctccccagttcctgagaaatgcatccttaggcgatttgtccttgtgcaaatgtcagtgtacttacacacacctgaatggcactgcctgctgcacccctaggccatatggtatagtgtagcctgttgtccccctgggctatatggtgtagcctgttgcccccctaggctatatggtgtagcctgttgcccccctaggctatatggtgtagcctgttgcccgcctaggctatatggtgtagcctgttgcccgcctaggctatatggtgtagcctgttgcccccctaggctatatggtgtagcctgttgccccctaggctatatggtgtagcctgttgcccccctaggctgtgtggtgtagcctgttgcccccctaggctatgtggtgtagcctgttgcccgcctaggctatatggtgtagcctgttgccccctaggctatatggtgtagcctgttgccccctaggctatatggtgtagcctgttgccctctctaggctacaaacctgtacagcaggttactggactgcatactgtaacacaatggttttgtgtatctaaacatagaaaaggtacagtaaaaatatagtattgtaatcttgtgggaccaccatcatatatatgatctatcattgaccaaaacactattatgcaacacttaactgtatacatttaggggtcactgctgaggagttgatagttttggctgtggatatgaggttcacttagaagtgaatgagaagtgagatcctaggaaggaacatgaagtatttactacatatttaaaaggaaagatgcatttggcacaatggtaggaaaatgaggacagtgcacatcctataggtcaaggaagaatatattaaggataaagagattaatagcattgactacttctgagagcttgagtaatatgaaatggaagtggccgggtgtggtggcttacacctataatcccagcacttctggaggctgaggcagatggatcacctgaggtcgggagtttgagactagcctgaccaacatggagaaaccccatctctactaaaaatacaaaattagctgagcatggtggcacatgcctgtaatcccagcttcctgggaggctgaggcaggagaatcacttgcatccgagaggcagagattgtggtgagccgagattgcaccattgcactccagcctgggaaacaagaacgaaactccacctcaaaaaaaaataaatacataaaataaaatcagttggatttagcaatatggaagcgattaagacctgtaggcagaaagagacagaaagcaaattggactgaacacaggaatggatagcataaaccaacacacacaccagagtgcatttgggaggccgaggcgggcggatcacgaggtcaggagttcgagaccagcctggcctatatggtgaaaccccatctgtactaaaaatacaaaaactagccgggcgtggaggcacatggctgtaaacctagctactcaggaggctgaggcagaattgcttgaacccaggagaaggaggttgcagtgagccgagatcacgccactgcaccccagcctgggtgacagagcgagactccgtctcaaaaaaaaaaaaaaaaaaaaaaaaaagggagatatagtcttttttttttttttttggagacaacatctcgctctgtcgcccaggctggagtgcaatggtgcaatcatagctcactgtagcctcgaacttctgggatcaagtgatcctcccacctcactcttccctgtagctgggaccacaggtgcaagccaccatgcccagctaatttatcttttgtagagacaatgtctccctgtgttgcccaggctggtcgcaaagccttggcctcaaggtgtcatactgcctgggcctgctgaagtgttcatattacagaaggaaccaccacgtctggcctacattagctttttaaaagttaattttagaaggtcctgattgaggaatagtttcaatattgaaaagagaaaacgaatcacctatagcaggggtaggcaaactgtggcccctgtttttataaagttttattggaagagtagagccacatgcattaatgtaagcactgtcctggctgtgtatgcactagagcagcagagttagtttcaagagggacagtacgaccaataaagtctaagatattaattacctagttttttacagaaaaagtttgccaagccctgatctccaggtgaggatttcctaaaagccctcaggaatttggaggaaatacaaggtaggaaaaaattggtttattgcaagacagaagaaaggagaaagaataggtgaaggtgaatttgcaatttgttgctcaaaagatgagaaatgttgactgctgggctccttgaaagattgatcatccgaaaatcctgttgatcgaacaaagctttagagctttgacagagtcaggctctctgtcataagcacacaacctgacagtcttatcagtgtgtcagatggagaaagaggggaaagacacagggtctgggttggaaggttcaaagggggtcttgcaggatgtagaactagttggaattggagtttttggacattatgaatgcattttttaaaaatatggatgaaaggctgggcgaagtggctcatgcctgtaatcccagcactttgggaggccaaggtgggtggatcatgaggtcaggagatggagactatcctggctaacatggtgaaaccccatctctattgaaaatacaaaaaattagctgggcacggtggcacatgcctgtaatcccagctactcaggaggcggaggcaggagaatcgcttgaacccaggaggcggaggttgcagtgagctgagatcgcgccactgcactccagcctgggcgacagagtgagactccatctgaaaagaaaaaaaacagatgaaaatgtatagaattatgaccaaaatatttaactaataacttagttattattatgatattcacaaggtaatttcaatatattaattttctctgtcttaaattcaatattcgaagataattagctgttaacaaataacctgcagcctgacgaatatggtgaaatctcatctctataagaatacaaaaattagccagctgtgttggtgggcacctgtaatcccagctacttgggaggctgaggcaggagaatcctttgaactctggagttggaggttgcagtgagccaagatcatgccattgcactccagtctgggcaacagaaaaataaataagtaagtaaataaataaatagatagataaaacttggaaagccctcactacatgggtacattaggaattcctgcactttggagaaagaatgctgataatggtttaacaacgttctctgatttttcagtttgctaccctcgttttttgctattattgttggtctaggtcagggtttgtcagcctcagcactactatgttttgagctgaatgattctttgtgcgtcaggctgcgctgtccatcgcaggatatactgcagcatcactggcctctattcaccagattccggtggcacggctcttctggtgacaactaaaaaattgctccagacatggtctagcttattataaacaattttatttttatgttgtgggttgtatagcaatgtttgatccaaagtatttatcttagcttgaaatttgcagtagctagacatggagatgtctattactgggttttgaacattaattatacatttattgctaaatcatctcacatttccctttatgagtcatcatcatattttcttaaaaaattaggtaagggtttgagagccattgctctgaattcttttttttatttttatttttttgagacagaatcttgctctgttgccaggctggggtgcagtgcagtggtgcaatctcagctcactgcaacctctacctctactgaatcgcttgggttcaagcgattcccctgcctcagcctctcaagtagctgggactacaggggtgcaccacaacctctggctaacattttgtatcttagtagagacagggtttcaccatgttggccacgatggtctcgatctccggacctcgtgatctgccggcctcagcctcccatagtgctgggattacaggcgtgaggcatcgcgctcggtctgctctgaattcttcatcccagtgtttcaaataattgtctcacttccagctcacttatctgacctgaccctgacttttccaatagagccatttcccccaattctccatgtgattcagcaacaagatgtattgtgacttttccaagtgtatatctttaccagaatatacttattcacatcttttttttttttttttttgagacagagtctcactctgttgcctaggctggagtgcagtggtgtgatctcagctcactgcaagctccgcctcttgggttcacgccattctcctgccttagcctcccaagtagctgggactacaggcgcccgccaccatgcccggctaagtttttgtatttttattagagacggggtttcaccatgttagccaggatggtctcaacctcctgacctcatgatccgcatgcctcggcctcccaaaatgcagggattacaggattgagccaccgcgcccggccttattcacatcttttaaaagcacattttgagaattcgaaatggtcaaaaatgtctccccaaaagataggtaagcaagatcctacatcttccttgactcccatgagtcaacagaggcaattttctgacatttgcctttcgttccttcctcctctgcccatcctaaagaacttggcctccatgagccagagcccacctacagagggctgtgtacatgatatgctgcttctattttctgtgggaactgacttgcattttgagaacatttgagtaaaactggaccaccgttccacctagtcatgctcattacaactgatccctgtgcgacaggagtcaaggcggagcttgctttttgatctgatgaccgtctcaatttaattccttctccttgtcactagatatgtaacagcaatgtcactttagaaaaaacaaatcagctctctgagcatcagtttccacatgagtaaaaagattaatgcacactcataggttgttaaaaacattaaaggagataaagcatgatagaacttaaacataaaagtccctatgtagatacttattttctcagcattatacaaccatccctgagcaaggatgtaagagaaggcatttgcctgtagaccaccaaacagagaaagaagagggtgaacaccaggcatcatcggtattacttacctgattcaaaccattacctgtcgggcttcttctaataaatcaaattgttcctatcagaaagagaggtaggccgggtgtggtggctcacacctgtaattccagcactttgggaggctgaggctggtggatctcttgaggtcaggagctcgagaccatcctggccaacatggtgaaaccccgcctctactaaaaatacaaaaattagctgggcgtggtggtgggcacctgtaatcctagctactcgggaggctgaggcaggagaactgcttgaacccggggaggttgtgatgagccaagatcgagccactgtactccagcctgggcgacaagagcgaaatttcgtctcaaaaaaaagaaaaagaaaagaaaatttaaaaatattcacattttccacaactccttcttatccacataaaatatctatataaattattattctctatttggaataaaacactttaggaagtcctgatactcactgtcagtaatggacacctgttccgcatggtggcatgctcatatctaaagtcccgctttcattcctgattatacctgattctgcaaatgttttcagaaatacatcaagttcctaacctagttctaaggaccccagactgtatttcttctctaattccccaagcttacgatgcatatgcattttttctcattagcataggatctccccgttattatcattcatgattcaggttaagtgcaacctcttccactacacacaggtgttgacagttacacaaatgcaaaggctctggatattaaatcaggctcctactcctggaacgctttttattgggttagtttacacaaattctttcaaagtcttgttctccaactttctggtgtctcgtggtcttggattttacacacagaagattaagggctaacagtagcatcacaagaaggaccatgttgtaagatggtgagggagtctggacttgtgtctccatttgggatacagagggaaaacacaggcctgagagctccttggaaggcgcaatgggagaaattgtaaatgagggacatctcggtcacattgtagaatgatatctgcccgtgttcgcagtcaaggaaaacgccaactgtgtccaacttcttttccaggaagagccttttcagaggggggaagacccagagagtccactcggtccccatcaccgaccccgtgagcaagactttctctccggaagctctggccgtgctgcccttcgcgtctgcagagccgtggtatatgcccacttgccacctggttgccttttccacgtccacctcccagtagtgcctccctgaggtgaagctctccgcagccagcaccatggcactgaaatccaatctttctgggttgccagccccatcctgctgcccatgtctcaatctcatagttctcaggtcctcagatagtgccaggcagggatgagctgtttcaggatccaatgttaaatgtcctatcaggagagaaaaccctcgttaacctaggagttcaccaatgccaatgccagagacatgatttctaacacacctgggcttcccactgagtgggcacaagtcccaggcccagatacgggagaggcaatttgggagggtccaggaaaaggaactgctgaacttcaatatggacctcatggaggaaaaagtccataagatatggaaagggacacagtctacctgagcgggaagaataaaacaaagatgaatgagctaaggaaggtttagaaacaccttcatccaacgtggcgcggtggctcacgaggtcaggagttcaagaccagcctggtcaagatggtgaaaccccatctctactaaaaaaatacaaaaagtagccgagtgtggtggcaggcgcctgtaatcccagctactcatgaggctgaggcagaaaattgcttgaacccaggaggcggagattgcagtgagccgagatcacaccactgcactccagcctgggcgacagagcaagactccatctcaaaacaaacaaacaaacaaacaaacaaacaaaaaacagcttcaccccagagacggtcaaactgtcctggtgccaagttccatccagatatcacttggggcccaaccctggtcttctagatctccaagcctggagcggccacaggagtcggccagcagcaactcattcgtggccctcccgatgccgtactctacacatcttaaatatccccacagggtgacatagaggcctggaaattgctgacaacaggccctggacatcaggcattacatcagataatttatcagcggaggatggaacacctgtgtggaccctccagaaactcacgctgagaacacgcaggctcaatgaattcctcacacctgcatgaatacgtcttcttcctatctctgactgttcctctcatctctttctgcccagcctctaactattgtgatctttcagggcttggtcctgggacttcttctttcaagtagtatattctccttcactgcccccaggtaactgtgcatagcttcagttttaaacatcttctctgtgtttgtgactcgctccataaacagctaaataccagttggaaaaaacacaggaatttcaaacataacacacccaaaatggaacttcaacgccagccctctgcagtctctacttctcagttcacagctccctcattgcttcagttgtctaagccataaacctggaaggcctttatttcctactttctgtaatgtggaatccagcttaatttctattatttgactgaagtaaatttaatgaacttaaatctctgaatttgaagcccaattcacattattagggtggtctcaacagctacacgtcttgaatttttaaaaaattgtctgagactctcagtatttccaggagactggcagaaacaaatgcaaattatctctggaaaaacgcacagctgtggctgggcacggtggctcacgcttgtaatcccagcattttaggaggccgaggaggacggatcacttgaggccaggactttgagaccagcctggcgaaaccccatctctactaaaattacaaaaatcagccaggcctggtggcggcctgtaatcccagctactcaggagggtgaggcaggagcatcgcttgcatctgggaggcagaggttgcagtgagccgagatcatgccactgccctccagcctgagcaacagagcgaggctcatctcaaaaacaaaaacaaaaaaggttgaagaaacaacaggagtatctcaagagaaaaagaacttgataaattcaacattgattcataaaaattcttagtaaaccagaaataaagggggacatcctcaatttgatgaaaggcagccattaaaaaaaactatagctagggccaggtgcggtggctcacgcctttaatcccagcactttgggaacctgaggcaggcagatcacgaggttgggagttcgagaccagcctgaccaacagagtgaaaccccgtatctactaaaaatacaaaaattagctgagtgtggtggcactcagctactcgggaggttgaggcaggagaatcgtttgaatctgggaggaggaggttgcggtgagctgaggcttcgccattgcactccagcctgggtgacagagccagacagcatctcaaaaaacaaaaacaaaaacaaaaacaaaaacaaaaacaaaaaacacaaaacaacaacaaaaagcgctatagctgtatcagaatttagagtgaaaagacttaatgttttctttcttcctaagatcgagaataagcaagtgtccactctcaccacttctgttcaacacactgcaggtctgagccagtataataaggcaagaaaaattcagaaaaggcttacagactggaaaggcagaaataaagctatctatactcatatactgcatgactttgtagaaaatcctgaaggatctatttatagaaatccactgtctaatgagtgagttttgcatagttatagggtacaaatgtcaatatatataaaacaattccatttctatatacttgcaatgaactagaaatgaatgaaatgtcaattagaaattgatattttaaaataccgtttacagtggctgtaaaaaacataaaatacttagggatacatctccaaatacatataacattttatgctgaaagtgacaaaacactgatgagagaaatcgaagacctaaataaatggagatattttgtattcctggactgaaagcaccaaatattgtcaagatgtcaattctccccaaactgatcaacggattcaatgtaatatgaataaaaatcccagcggtccattttgaagaagccaacaagctgatttcaaaatttatgtggaaaagcaaacaacctacagtagccaaaactattctgaaaaagaataaatttggagaatgcacagtacctgctttcaagacttcctacagagttatcaatcaagccagtgtgctattggcaaagggaaagagtcaaccatcaatagacctattagagtcacaaatagacgtgatcgcatataccagttgattttcaacaaaggggccaagtaaattgaatggacaaaggtagtgtttttaacaaatgaaactggaacaaatggatacatgtgagtcaaaaaataaaaatagaaggtggggggaggagagggtttgcaccattctgtgaactgtatacagatattaactctcagtggttcataggccacaatgtaaaaccgaaaaccataaaacttttggaaggaaatctttgttggctttggcaaaatttcttaaataagacacaaaaagcagaagtcataaaagaaaaaacttgataaattgaacttcatcaaaatgcaaaacctctacacttcaaaagacagtattaggaaaatgagaatacaaaccatgctgggaggaaatatttgcaaaatttatctgataaatgaatgctaaacagaacatataaagaaattataaaactcaagagacatacaacccaatttagaaaaggggtttgtacatgtatttcaccaaagttgagatagagggaaaacaaacacatgaaaatatgctcagcatcattagtcattctggaaatgcaaattaaaatgacataccactacccatctatcgggtcggatgtagtaaaacaaactgacaataccaaaccctggtgagaatacagagtaactgaatctttcgcacgttattggtgggaaggcaaaatggcacaggcaatttggaaaacaagtttggcaatcccacccttagacagtcaatcaagaactatgaagctgtgcccacacaaaaatctgctgctaatatttacagcacagagctggaaacaacccatgtccgtagaattgcaaaaggataagtaaattatggtatatttatacaatggaatattatcaacaataaaaaggaacaaactactgatacacgaagcagcctggacgttctatatgtcaactgcagtatgctgtcagcctcgaaaggccacacactgtaggattccatcgataggacattctgggaaaggcaaagctataaggacaggagatataaaccctttgttatacatgctgaatttcttccccagaagttttaaatttttaagcagtggaatctgcctgcaatcatgtttcatggctggggaactggtaaagaatctgcagccaggcgtggtggctcacgcctgtaatcccagcactttgggagcctgaggcgcgtggatcacctgagatcaggagttcaagaccagcctgaccaacatggtaagacctcgtctctaccataaatacaaaaaattagccaggcgtggtggctcacgcctataatcccagcactttgggagcccaaggcgcgtggatcacctgagatcaggagttcaagaccatcctgaccaacatggtaagacctcatctctactatacaaaaaattagccaggtgtggtggtgcatgcctgtaatcccagctacttgggaggccgaggcaggagaatcacttgaacccaggagggggaggttgcagtgagccaagatcgcaccactgcactccagcctgggcaaagtgaaactctgtctcaaaaaaaaaaaaaaaaaaaaaaaaaaaaaagattttgcatgggaagagctttcatatgagatcatacagttatttttttgatccttatctaatatgtataacatattaagctctccagtctcctaaaatttttatttatttattttaagacagagtctcattctgttgcccaggctggggtgcagtggtgtgatctcagctcactgcaatctccacctcctgggttcaagcaattctcccacctcagccactcaagtagcagggactacaggcacacgccaccacaactggctaattttcgtattttttgtagagatgggatttcaccatgttggttaggctggtctcgaactcctggcctcaagcaaaccgcccgccttggcctcccaaagtgctgggattacaggagtgacccactgtgctggcctaaaattgttaaactactggaatttgttttcatttatggcaggatggtcacctgattctcaaatgcagaacagtgccctgtgagtattcacatgtgtcaacttactctggagtactctgaacatgctgctgagtcctcttatgtggcataaactcaggtctgtgatatgagcgggctccagatgctcaagcagcagtgacttgctcctgaagagaaaggacagcctcagtcatctgcacagaccacaggccccttagtctactggatggatcccattacatcctaccagcaaatgcaatctccctatctcaatcaacatcttactggactctgattctc
